(12) United States Patent
Brown et al.

(10) Patent No.: US 9,670,488 B2
(45) Date of Patent: Jun. 6, 2017

(54) METHODS AND COMPOSITIONS FOR THE SPECIFIC INHIBITION OF MET BY DOUBLE STRANDED RNA

(71) Applicant: Dicerna Pharmaceuticals, Inc., Watertown, MA (US)

(72) Inventors: Bob D. Brown, Millington, NJ (US); Henryk T. Dudek, Wellesley, MA (US)

(73) Assignee: Dicerna Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 14/356,051

(22) PCT Filed: Oct. 25, 2012

(86) PCT No.: PCT/US2012/061918
§ 371 (c)(1),
(2) Date: May 2, 2014

(87) PCT Pub. No.: WO2013/066721
PCT Pub. Date: May 10, 2013

(65) Prior Publication Data
US 2014/0315983 A1    Oct. 23, 2014

Related U.S. Application Data

(60) Provisional application No. 61/556,151, filed on Nov. 4, 2011.

(51) Int. Cl.
*C07H 21/04* (2006.01)
*C12N 15/113* (2010.01)
*A61K 31/713* (2006.01)

(52) U.S. Cl.
CPC .......... *C12N 15/113* (2013.01); *A61K 31/713* (2013.01); *C12N 15/1135* (2013.01); *C12N 2310/14* (2013.01)

(58) Field of Classification Search
CPC ...................................................... C07H 21/04
See application file for complete search history.

(56) References Cited

U.S. PATENT DOCUMENTS

2007/0232555 A1* 10/2007 Shinomiya et al. ............ 514/44

* cited by examiner

*Primary Examiner* — Kimberly Chong
(74) *Attorney, Agent, or Firm* — Mintz Levin Cohn Ferris Glovsky and Popeo, P.C.; Christopher R. Cowles

(57) ABSTRACT

This invention relates to compounds, compositions, and methods useful for reducing MET target RNA and protein levels via use of dsRNAs, e.g., Dicer substrate siRNA (DsiRNA) agents.

56 Claims, 74 Drawing Sheets

DsiRNA-mediated Knockdown of MET in Human Cells, Primary Screen
Human MET-specific DsiRNAs
Normalized to HPRT and SFRS9; vs NC1, NC5, NC7

DsiRNA-mediated Knockdown of MET in Human Cells, Primary Screen
Human and Mouse MET-targeting DsiRNAs
Normalized to HPRT and SFRS9; vs NC1, NC5, NC7

DsiRNA-mediated Knockdown of MET in Mouse Hepa 1-6 Cells, Primary Screen
Mouse MET-specific DsiRNAs
Normalized to HPRT and Rpl23; vs NC1, NC5, NC7

DsiRNA-mediated Knockdown of MET in Mouse Hepa 1-6 Cells, Primary Screen
Human and Mouse MET-targeting DsiRNAs
Normalized to HPRT and Rpl23; vs NC1, NC5, NC7

Mouse MET Knockdown - Mouse (Hepa1-6) Cells – Phase 2
Normalized to HPRT and Rpl23; vs NC1, NC5, NC7

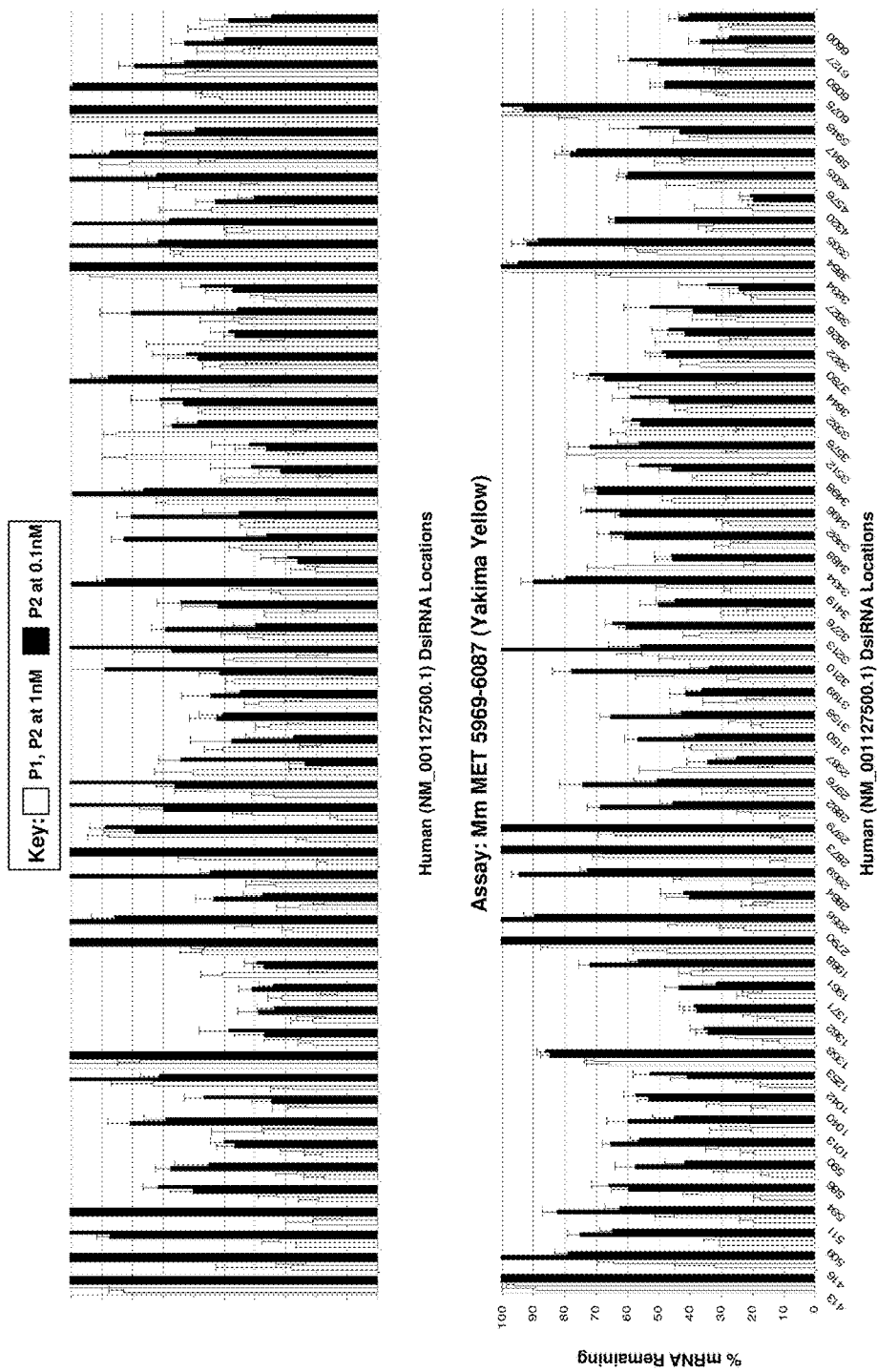

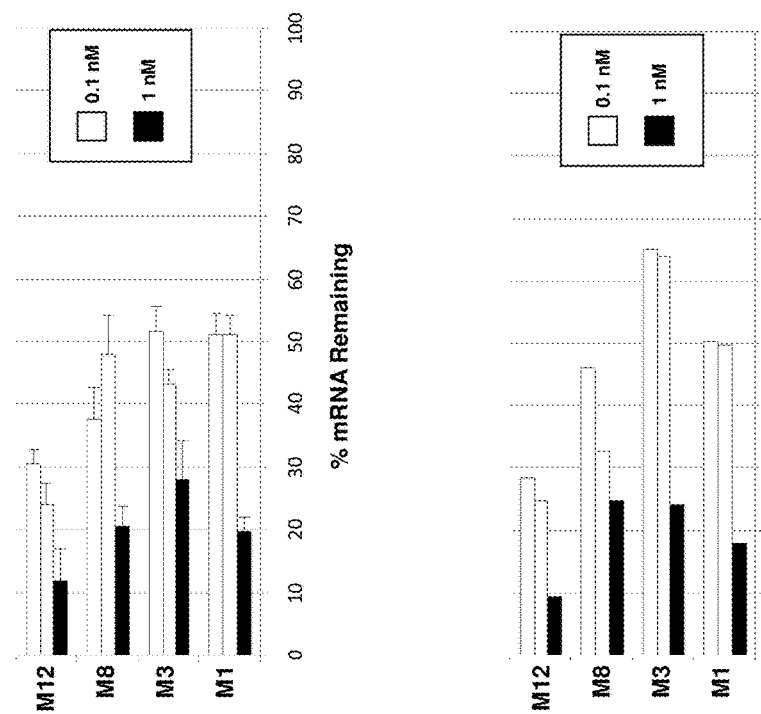

MET-590 Knockdown - Human (HeLa) Cells
Normalized to HPRT and SFRS9; vs NC1, NC5, NC7

MET-1036 Knockdown - Human (HeLa) Cells
Normalized to HPRT and SFRS9; vs NC1, NC5, NC7

Figure 4-6
MET-1362 Knockdown - Human (HeLa) Cells
Normalized to HPRT and SFRS9; vs NC1, NC5, NC7
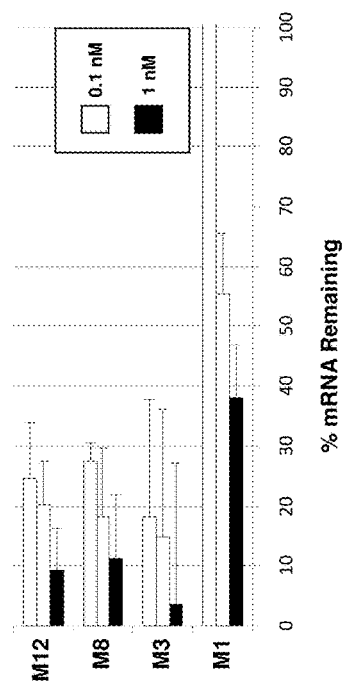
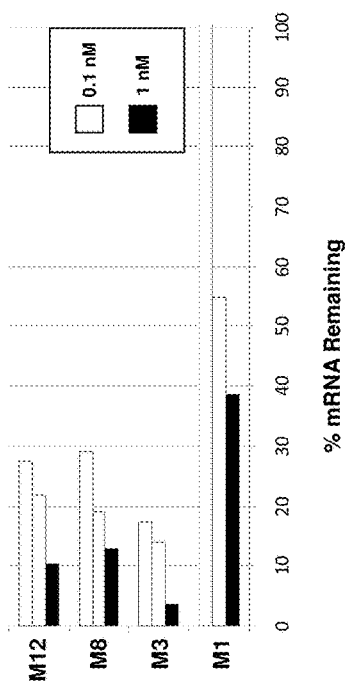

Figure 4-7
MET-1961 Knockdown - Human (HeLa) Cells
Normalized to HPRT and SFRS9; vs NC1, NC5, NC7
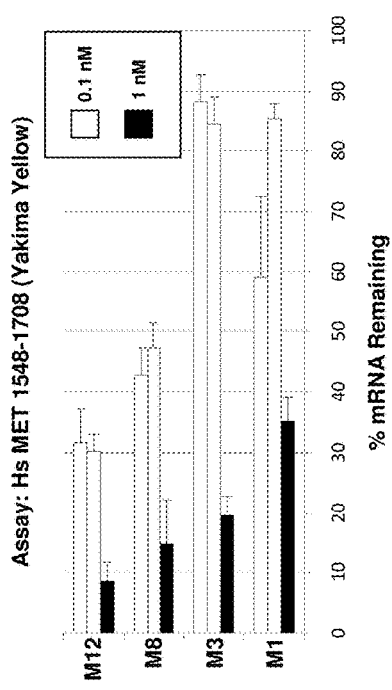
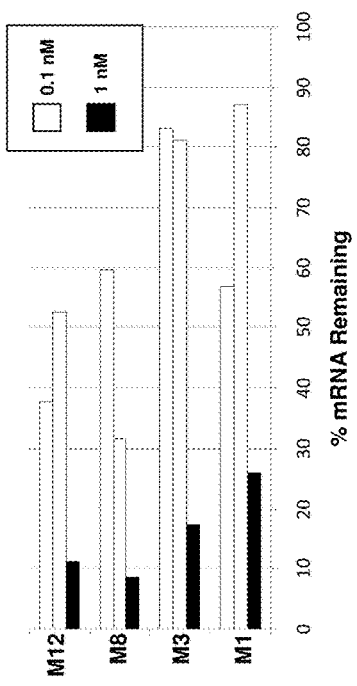

Figure 4-8
MET-1982 Knockdown - Human (HeLa) Cells
Normalized to HPRT and SFRS9; vs NC1, NC5, NC7
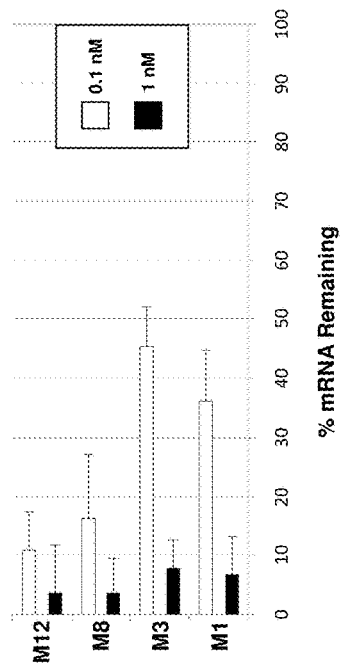
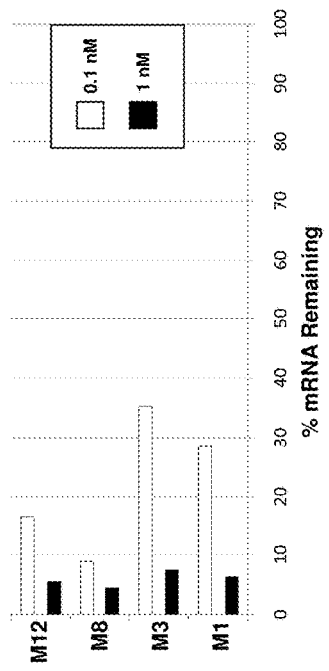

Figure 4-9
MET-2856 Knockdown - Human (HeLa) Cells
Normalized to HPRT and SFRS9; vs NC1, NC5, NC7
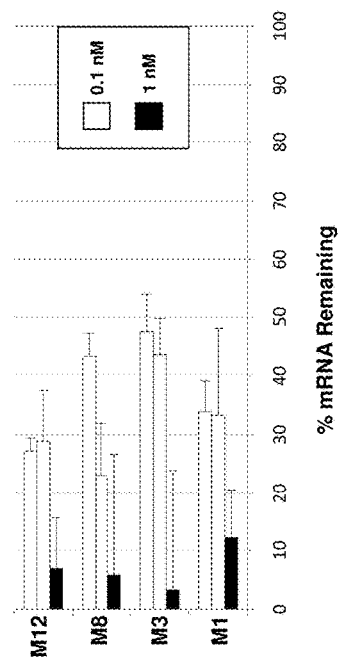
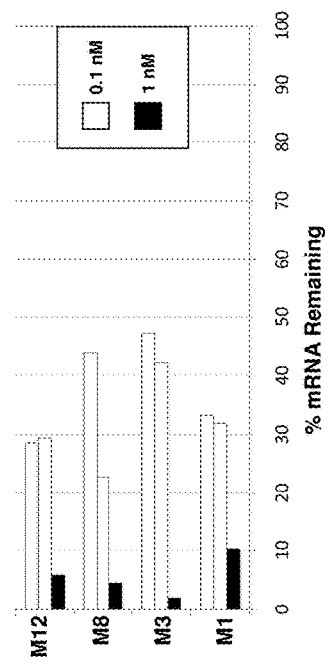

Figure 4-10
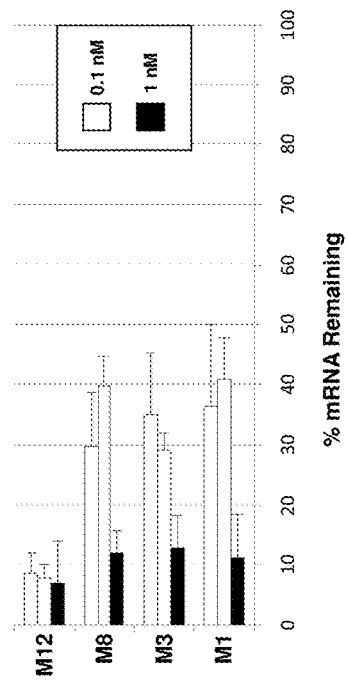
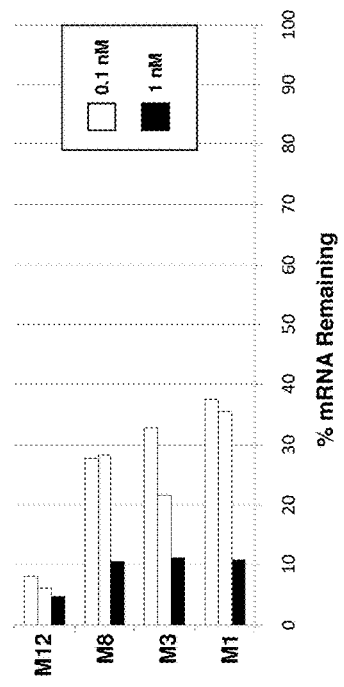

Figure 4-12
MET-3488 Knockdown - Human (HeLa) Cells
Normalized to HPRT and SFRS9; vs NC1, NC5, NC7
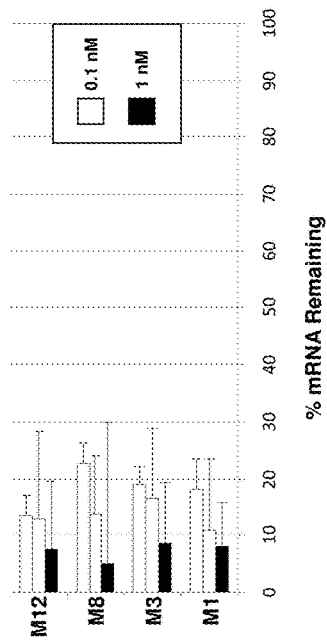
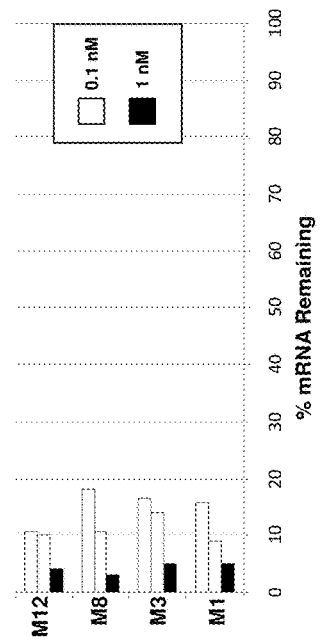

Figure 4-13
MET-3512 Knockdown - Human (HeLa) Cells
Normalized to HPRT and SFRS9; vs NC1, NC5, NC7
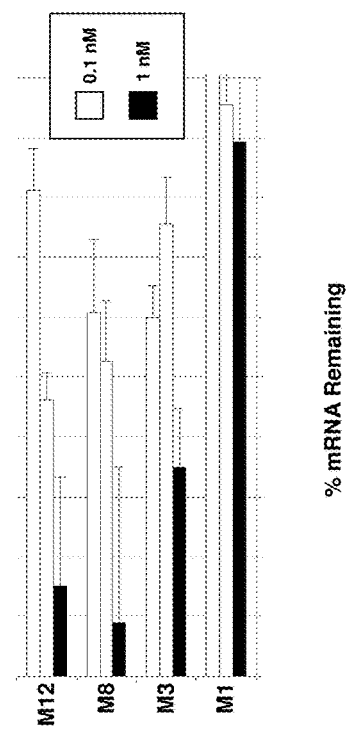
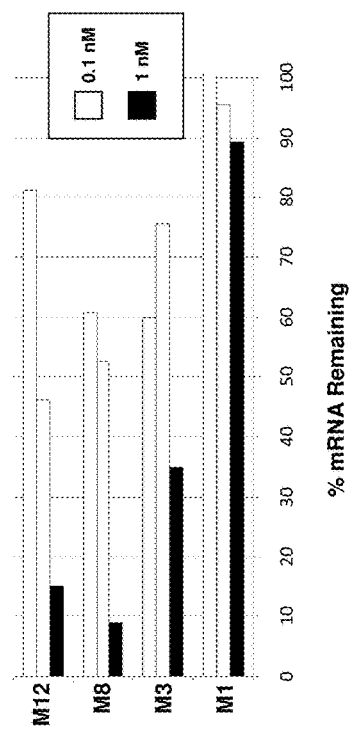

Figure 4-14
MET-3576 Knockdown - Human (HeLa) Cells
Normalized to HPRT and SFRS9; vs NC1, NC5, NC7
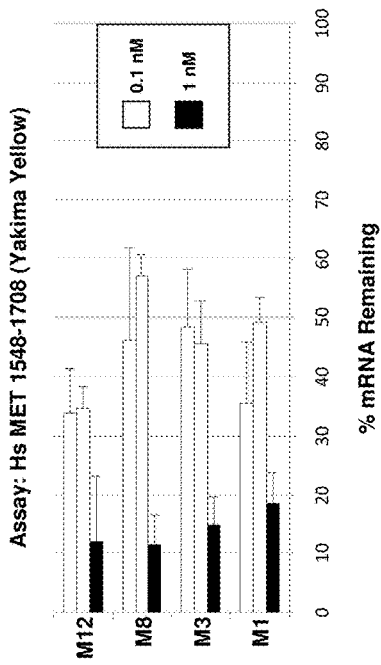
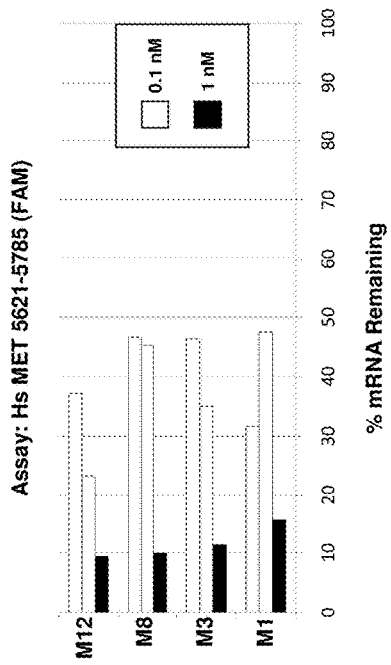

Figure 4-15
MET-3827 Knockdown - Human (HeLa) Cells
Normalized to HPRT and SFRS9; vs NC1, NC5, NC7
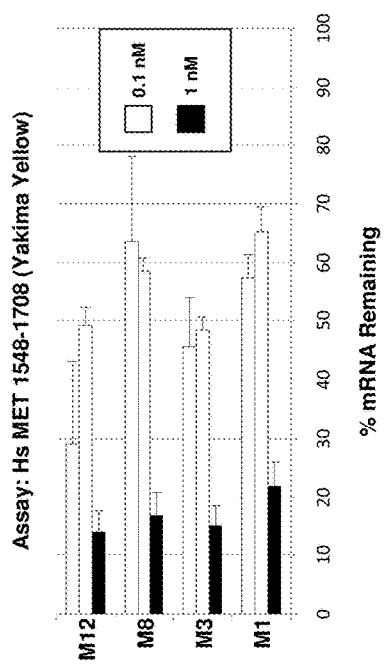
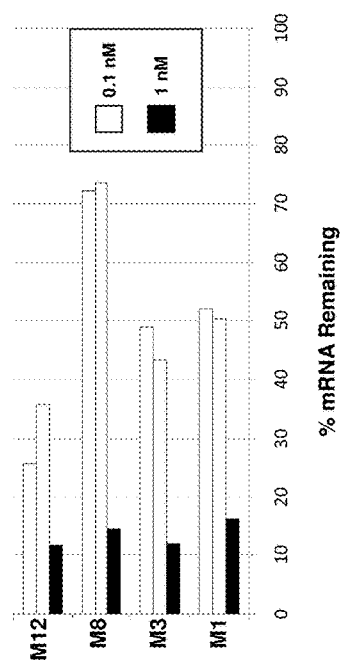

Figure 4-16
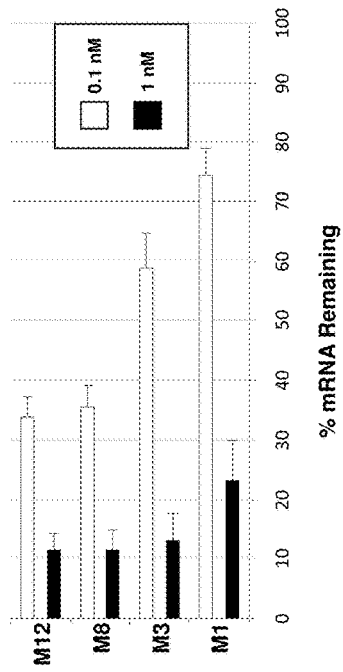
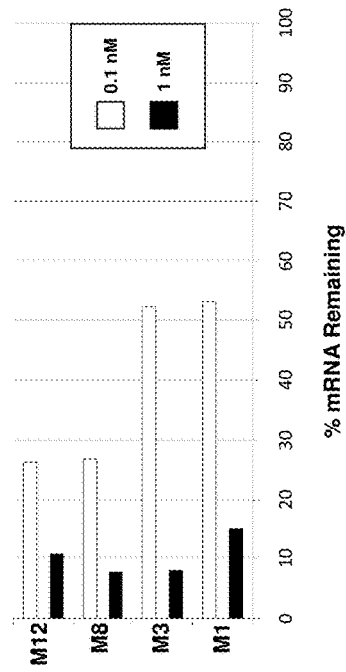

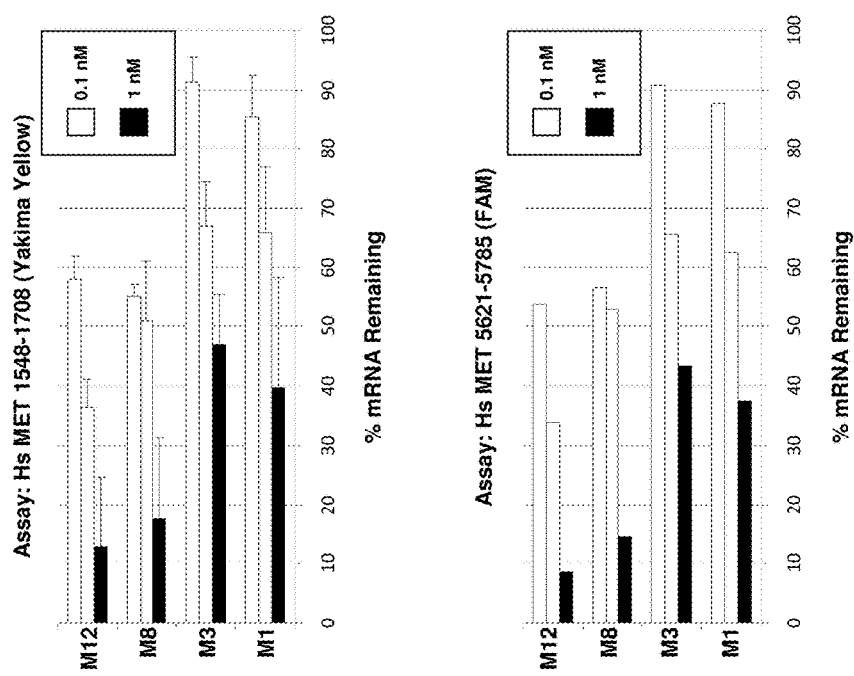

Figure 4-18
MET-5265 Knockdown - Human (HeLa) Cells
Normalized to HPRT and SFRS9; vs NC1, NC5, NC7
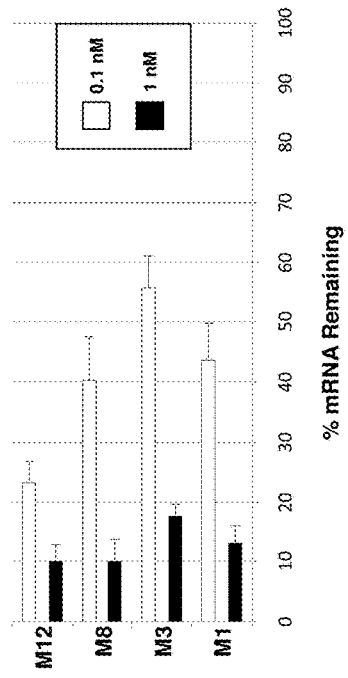
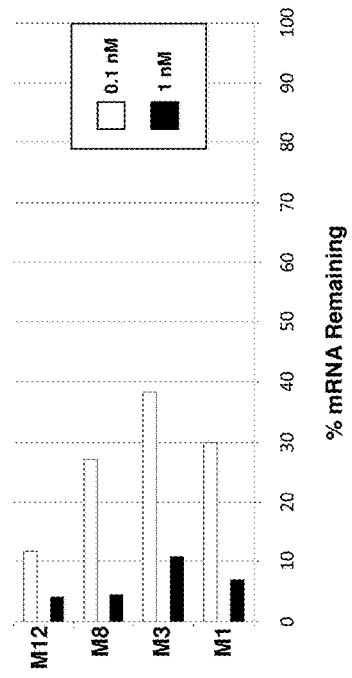

Figure 4-19
MET-5313 Knockdown - Human (HeLa) Cells
Normalized to HPRT and SFRS9; vs NC1, NC5, NC7
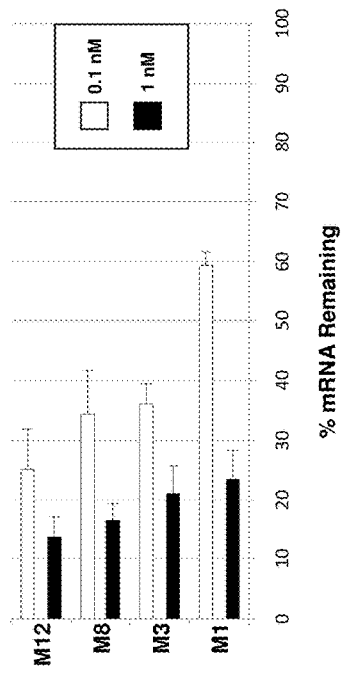
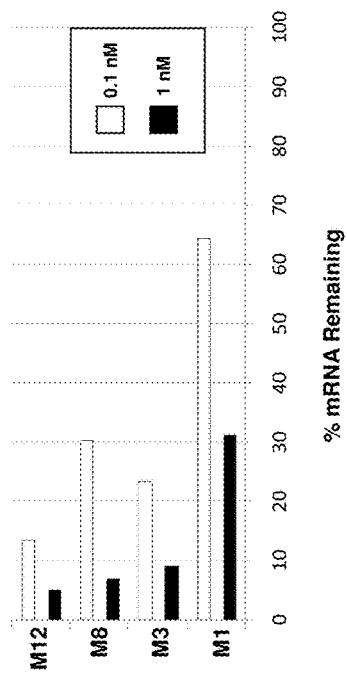

Figure 4-20
MET-5548 Knockdown - Human (HeLa) Cells
Normalized to HPRT and SFRS9; vs NC1, NC5, NC7
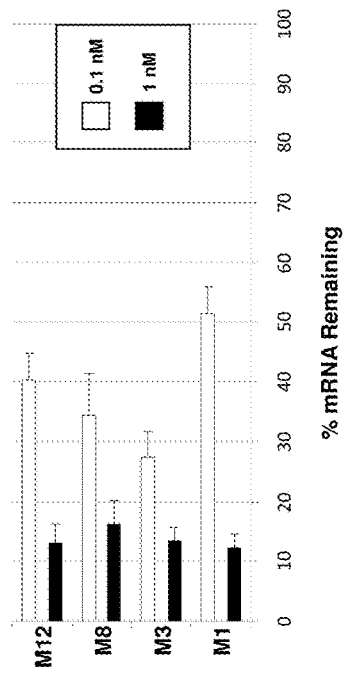
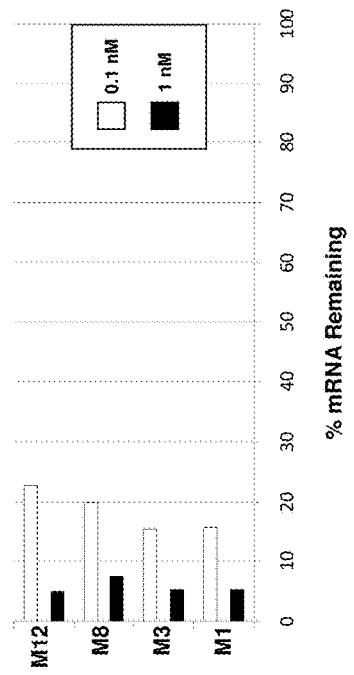

Figure 4-21
MET-6127 Knockdown - Human (HeLa) Cells
Normalized to HPRT and SFRS9; vs NC1, NC5, NC7
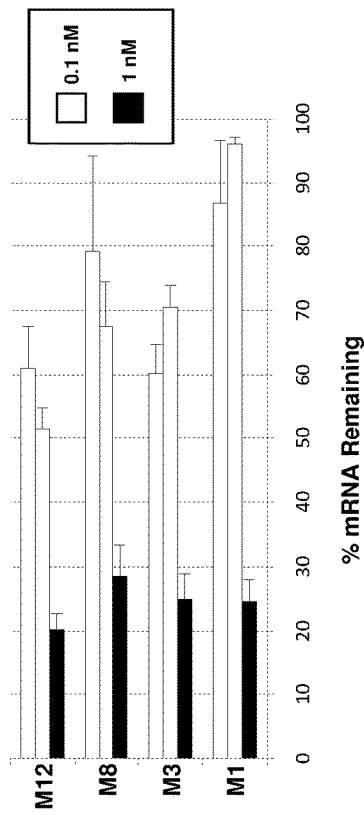
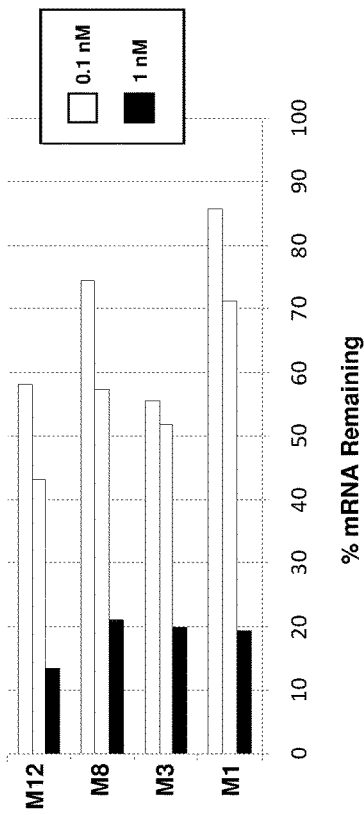

Figure 4-22
MET-6600 Knockdown - Human (HeLa) Cells
Normalized to HPRT and SFRS9; vs NC1, NC5, NC7
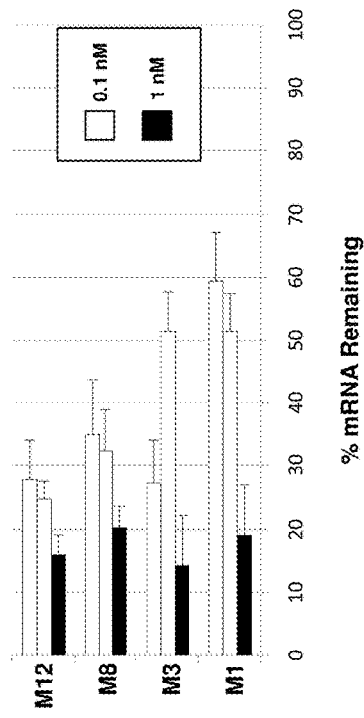
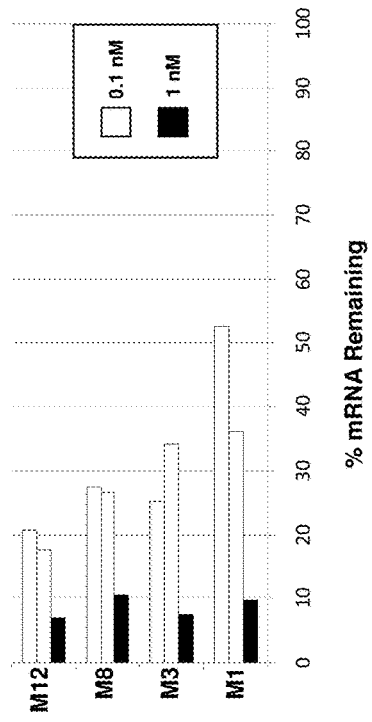

Figure 4-23
MET-m1644 Knockdown - Human (HeLa) Cells
Normalized to HPRT and SFRS9; vs NC1, NC5, NC7
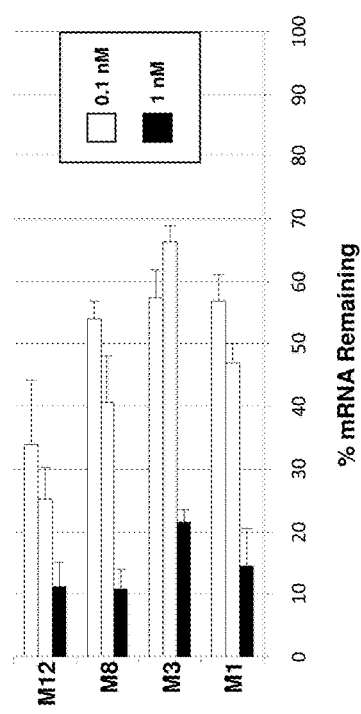
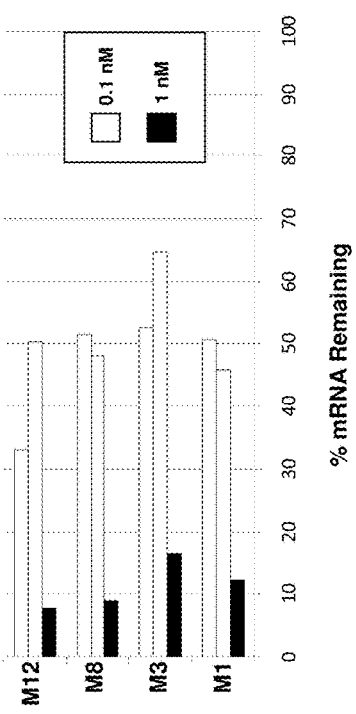

Figure 4-24
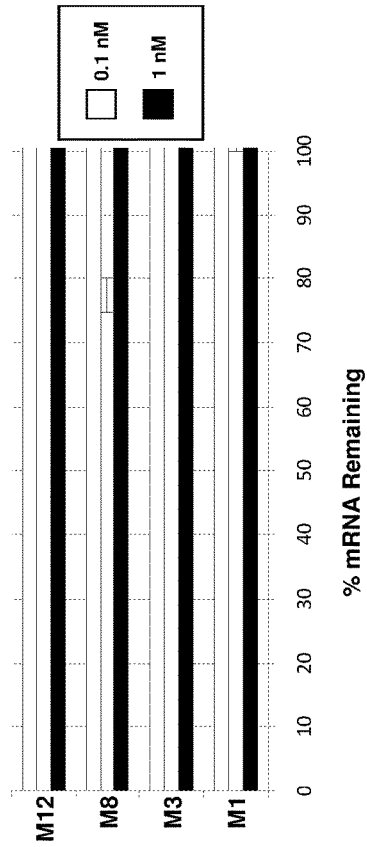
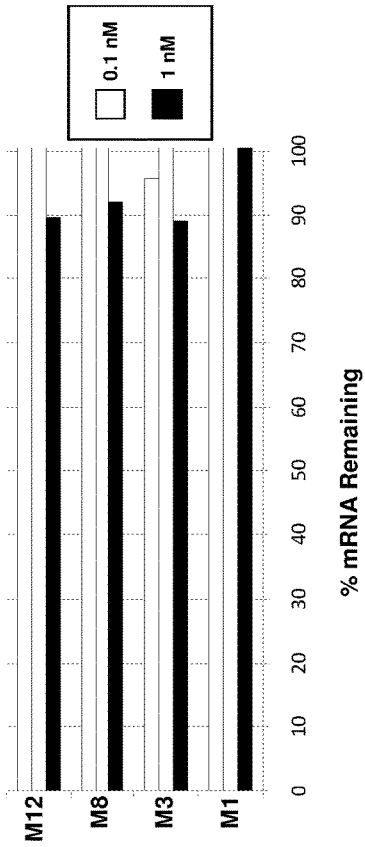

Figure 4-25
MET-m5259 Knockdown - Human (HeLa) Cells
Normalized to HPRT and SFRS9; vs NC1, NC5, NC7
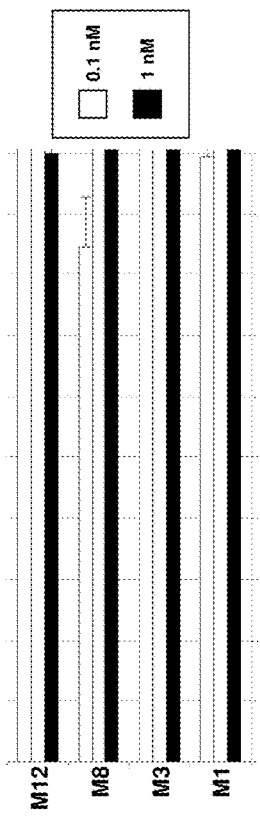
Assay: Hs MET 1548-1708 (Yakima Yellow)
% mRNA Remaining
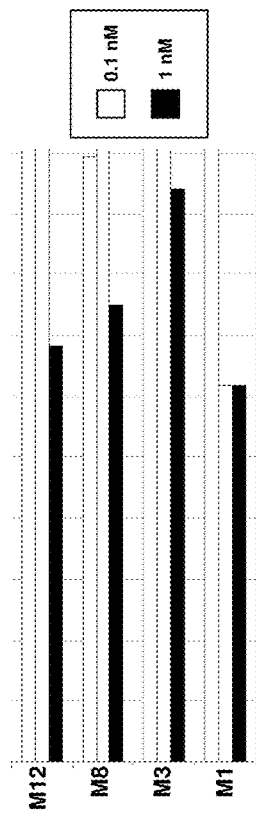
Assay: Hs MET 5621-5785 (FAM)
% mRNA Remaining

Figure 4-27
MET-590 Knockdown - Mouse (Hepa1-6) Cells
Normalized to HPRT and Rpl23; vs NC1, NC5, NC7
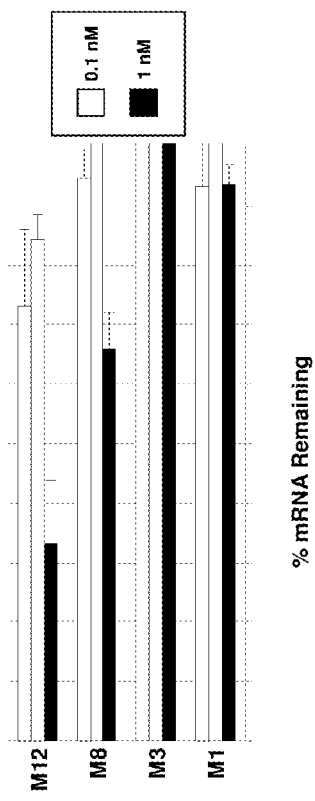
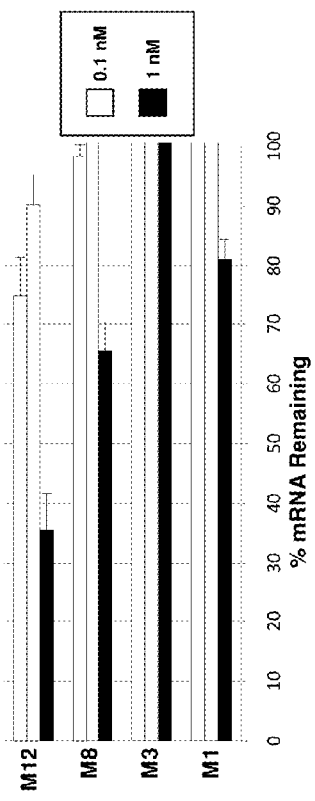

Figure 4-32
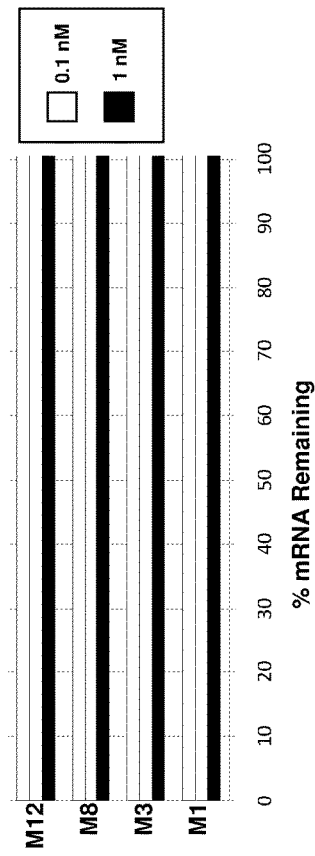
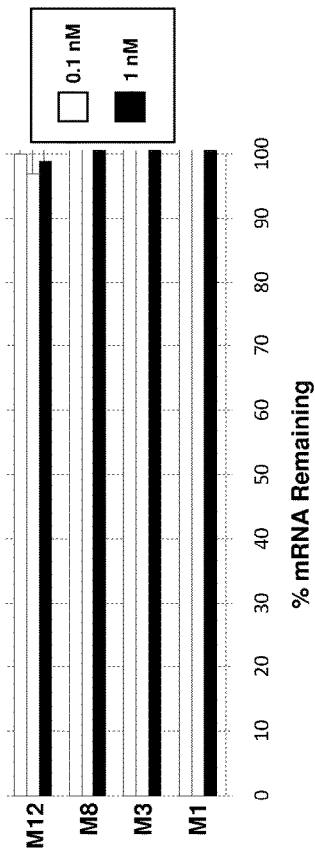

Figure 4-40
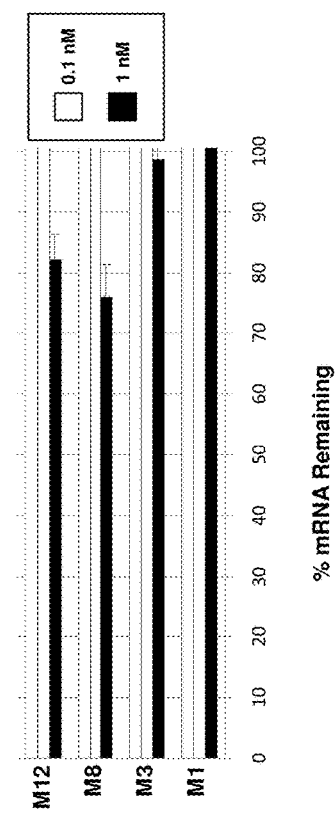
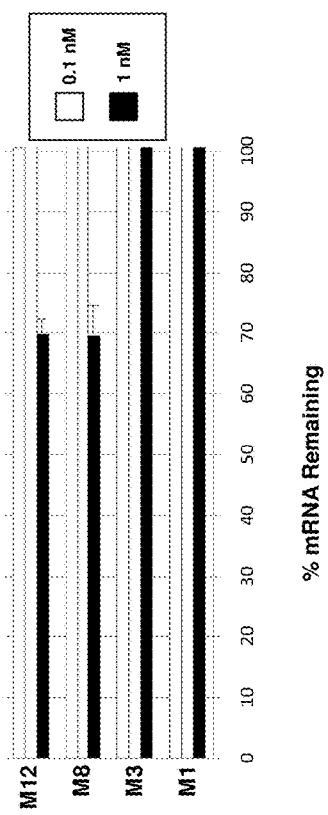

Figure 4-43
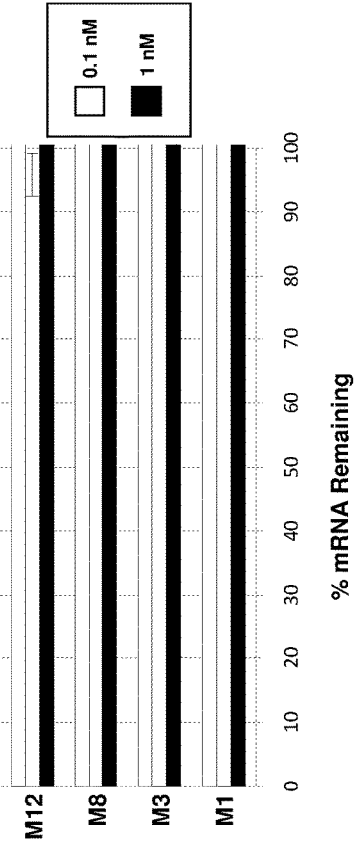
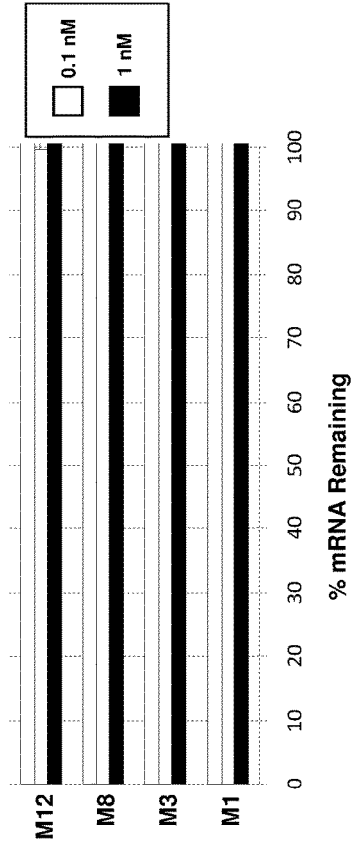

Figure 4-45
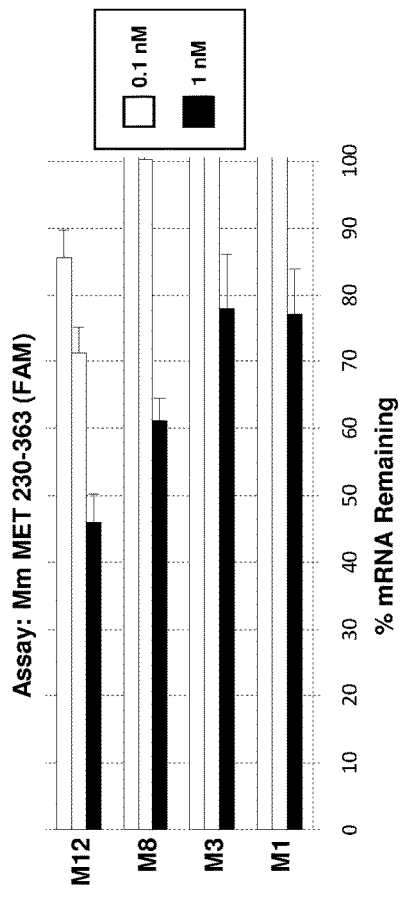
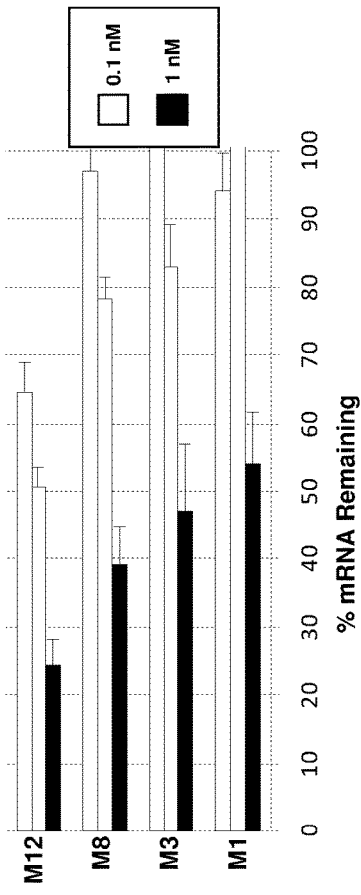

Figure 4-47
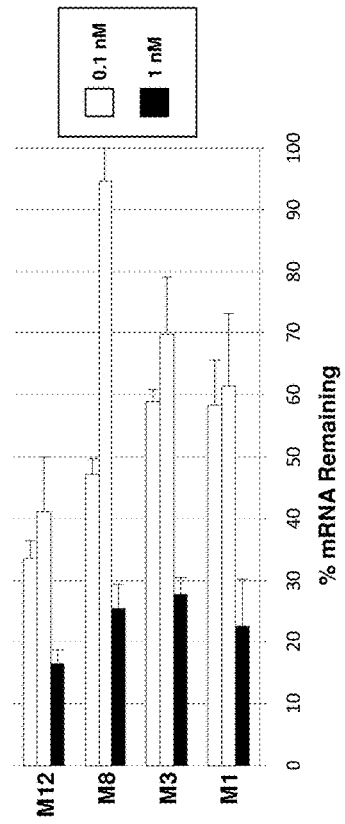
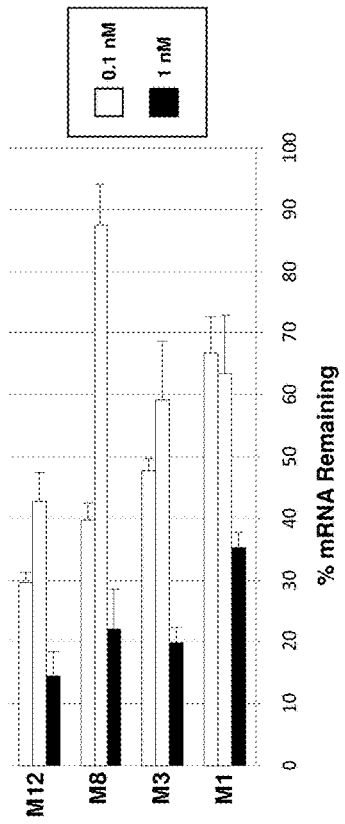

Exemplary Modified 25/27mer Duplexes

Exemplary Modified 25/27mer Duplexes (Cont.)

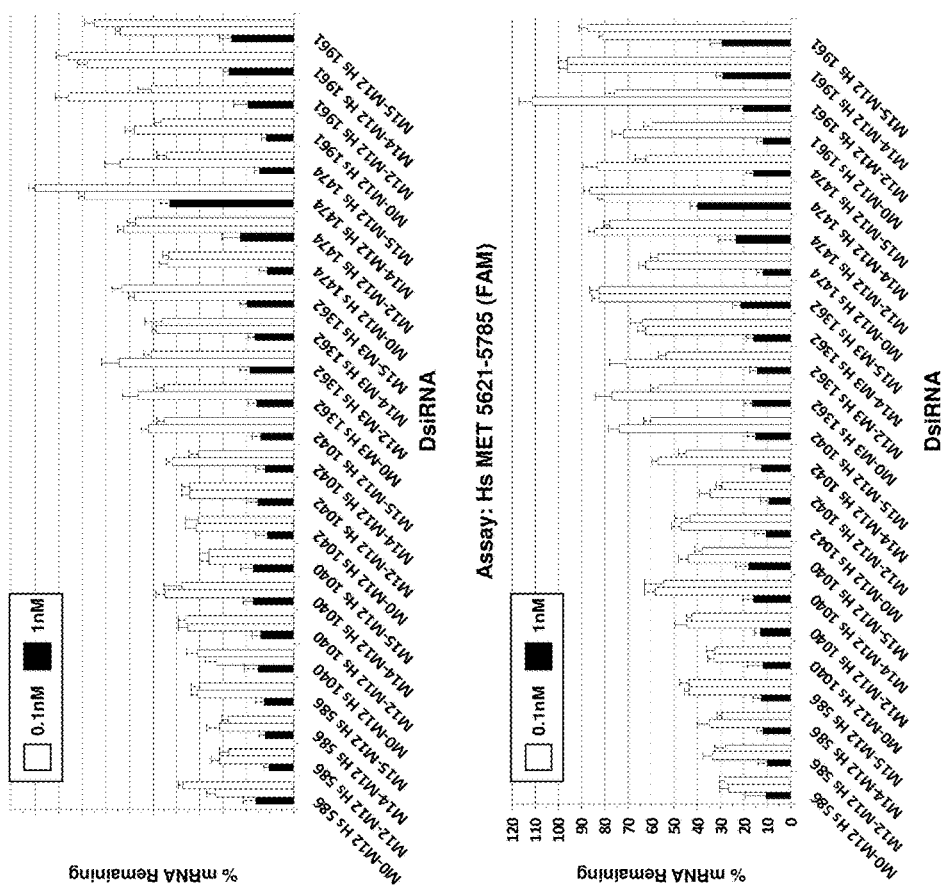

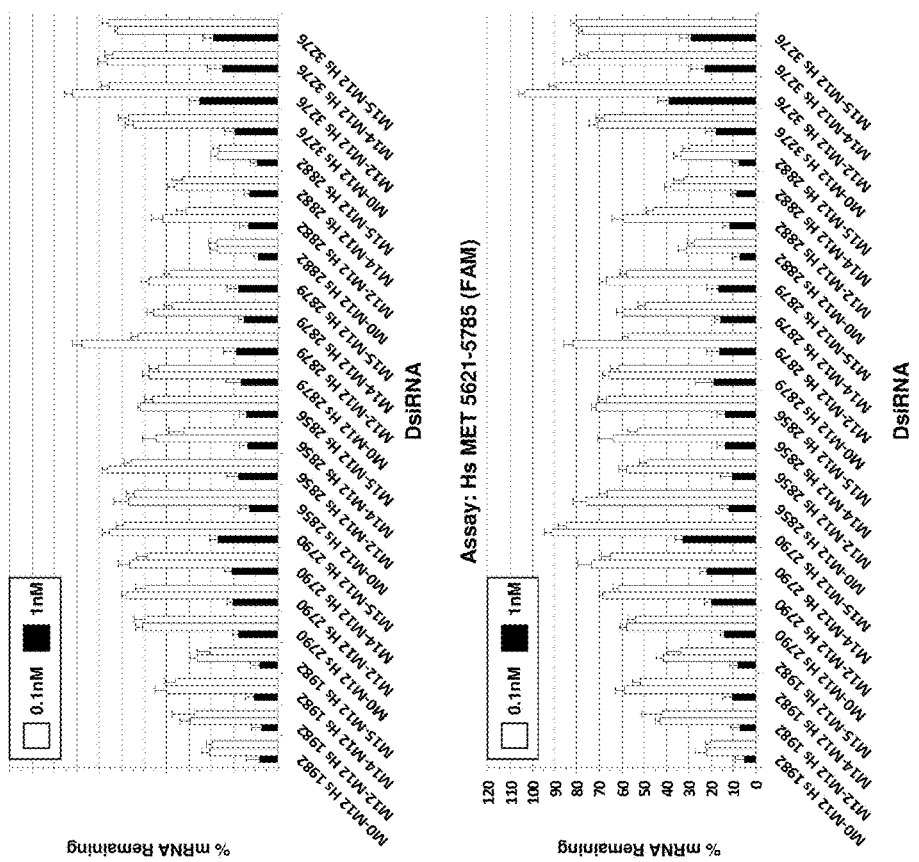

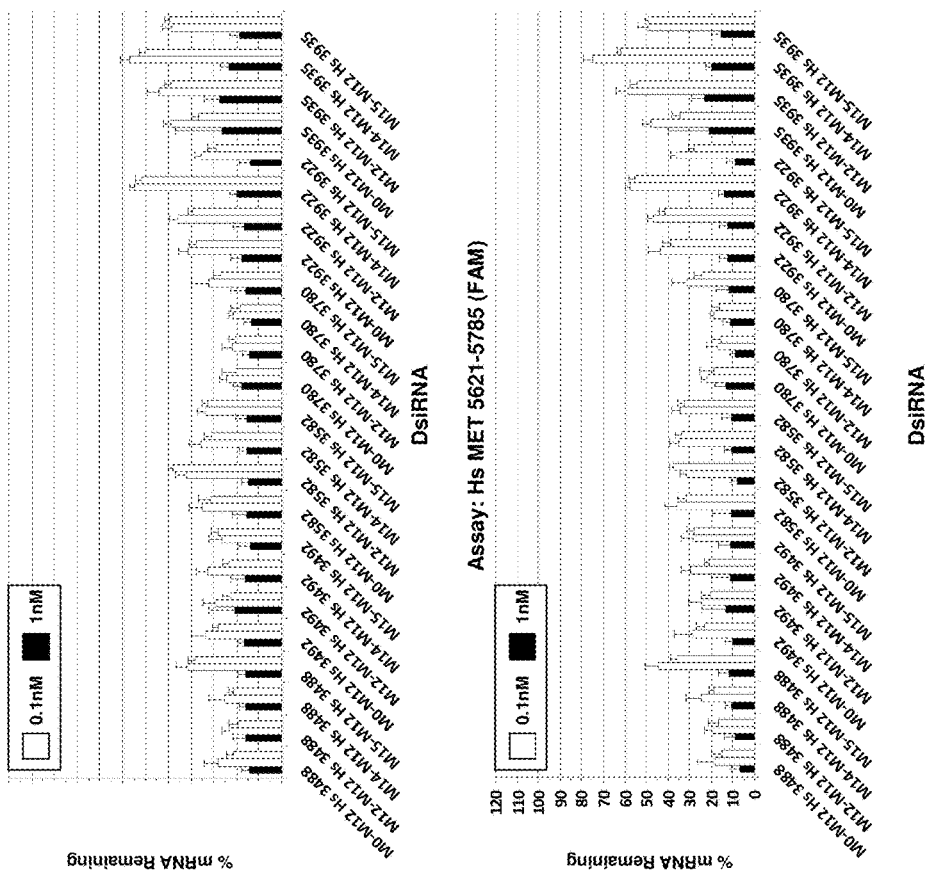

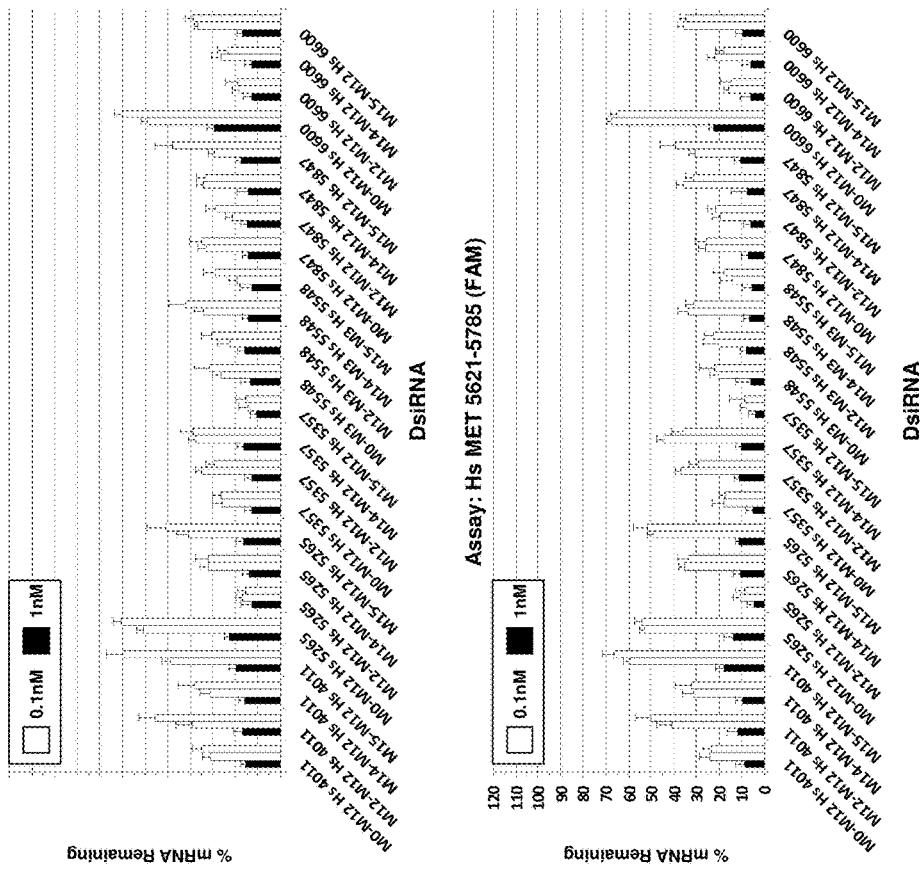

METHODS AND COMPOSITIONS FOR THE SPECIFIC INHIBITION OF MET BY DOUBLE STRANDED RNA

CROSS-REFERENCE TO RELATED APPLICATIONS

This application is the U.S. national stage pursuant to 35 U.S.C. §371, of U.S. international application Ser. No. PCT/US2012/061918, filed Oct. 25, 2012, designating the United States and published in English on May 10, 2013, as publication WO 2013/066721A2, which claims the benefit of U.S. Provisional Patent Application No. 61/556,151, filed Nov. 4, 2011, the contents of which are incorporated herein by reference in their entirety.

FIELD OF THE INVENTION

The present invention relates to compounds, compositions, and methods for the study, diagnosis, and treatment of traits, diseases and conditions that respond to the modulation of MET (Mesenchymal epithelial transition factor) (c-Met proto-oncogene) gene expression and/or activity.

BACKGROUND OF THE INVENTION

The c-Met gene encodes a heterodimeric transmembrane receptor (Hepatocyte Growth Factor Receptor, HGFR) with intrinsic tyrosine kinase activity and is composed of an alpha chain disulphide-linked to a beta chain. The beta chain (subunit) binds a c-Met ligand, hepatocyte growth factor (HGF). The alpha chain (subunit) contains an intracellular tyrosine kinase domain that mediates activation of a number of intracellular signal transduction pathways (cascades).

Intracellular signaling through c-Met is associated with regeneration of liver and kidney, embryogenesis, hematopoiesis, muscle development, and in the regulation of migration and adhesion of normally activated B cells and monocytes. The c-Met gene is primarily expressed in epithelial cells and has been found to be overexpressed or otherwise activated in a significant percentage of human cancers. Activation of c-Met may occur as a consequence of MET-gene activating mutations, MET-gene amplification/overexpression, and/or the acquisition of an HGF/c-Met autocrine loop. Any such development and/or combination can lead to cell scattering, angiogenesis, proliferation, enhanced cell motility, invasion, and/or the acquisition of metastatic properties to malignant cells. The overexpression of c-Met has, for example, been detected at the transition between primary tumors and metastasis. Using an Adenovirus-mediated RNA interference technique, inhibition of MET expression in hepatocellular carcinoma (HCC) cells was demonstrated in cell culture and animal model systems (Zhang et al., *Mol Cancer Ther*, 4:1577-1584, 2005).

Double-stranded RNA (dsRNA) agents possessing strand lengths of 25 to 35 nucleotides have been described as effective inhibitors of target gene expression in mammalian cells (Rossi et al., U.S. Patent Application Nos. 2005/0244858 and US 2005/0277610). dsRNA agents of such length are believed to be processed by the Dicer enzyme of the RNA interference (RNAi) pathway, leading such agents to be termed "Dicer substrate siRNA" ("DsiRNA") agents. Additional modified structures of DsiRNA agents were previously described (Rossi et al., U.S. Patent Application No. 2007/0265220).

BRIEF SUMMARY OF THE INVENTION

The present invention is directed to compositions that contain double stranded RNA ("dsRNA"), and methods for preparing them. The dsRNAs of the invention are capable of reducing the expression of a target MET gene in a cell, either in vitro or in a mammalian subject.

The invention provides for an isolated double stranded nucleic acid (dsNA) comprising first and second nucleic acid strands comprising RNA, wherein the first strand is 15-35 nucleotides in length and the second strand of the dsNA is 19-35 nucleotides in length, wherein the second oligonucleotide strand is sufficiently complementary to a target MET mRNA sequence selected from Table 15 along at least 19 nucleotides of the second oligonucleotide strand length to reduce MET target mRNA expression when the double stranded nucleic acid is introduced into a mammalian cell.

In one embodiment, the second oligonucleotide is sufficiently complementary to a target MET mRNA sequence selected from Table 15, along at least 20 nucleotides, for example, 20, 21, 22, 23, 24, 25, 26 or 27 nucleotides of the second oligonucleotide strand length.

The invention also provides for an isolated double stranded nucleic acid (dsNA) comprising first and second nucleic acid strands comprising RNA, wherein the first strand is 15-35 nucleotides in length and the second strand of the dsNA is 19-35 nucleotides in length, wherein the second oligonucleotide strand is sufficiently complementary to a target MET mRNA sequence selected from Table 6 along at least 20 nucleotides, for example, 20, 21, 22, 23, 24, 25, 26 or 27 nucleotides, of the second oligonucleotide strand length to reduce MET target mRNA expression when the double stranded nucleic acid is introduced into a mammalian cell.

The invention also provides for an isolated double stranded ribonucleic acid (dsNA) comprising first and second nucleic acid strands, wherein the first strand is 15-35 nucleotides in length and the second strand of the dsNA is 19-35 nucleotides in length, wherein the second oligonucleotide strand is sufficiently complementary to a target MET mRNA sequence selected from Table 16 along at least 19 nucleotides of the second oligonucleotide strand length to reduce MET target mRNA expression and wherein, starting from the 5' end of the MET mRNA sequence selected from Table 16 (position 1), mammalian Ago2 cleaves the mRNA at a site between positions 9 and 10 of the sequence, when the double stranded nucleic acid is introduced into a mammalian cell.

In one embodiment, the second oligonucleotide is sufficiently complementary to a target MET mRNA sequence selected from Table 16, along at least 20 nucleotides, for example, 20, 21, 22, 23, 24, 25, 26 or 27 nucleotides of the second oligonucleotide length.

The invention also provides for an isolated dsNA molecule, consisting of: (a) a sense region and an antisense region, wherein the sense region and the antisense region together form a duplex region consisting of 25-35 base pairs and the antisense region comprises a sequence that is the complement of a sequence selected from Table 17; and (b) from zero to two 3' overhang regions, wherein each overhang region is six or fewer nucleotides in length.

The invention also provides for an isolated double stranded ribonucleic acid (dsNA) comprising first and second nucleic acid strands and a duplex region of at least 25 base pairs, wherein the first strand is 25-34 nucleotides in length and the second strand of the dsNA is 26-35 nucleotides in length and comprises 1-5 single-stranded nucleotides at its 3' terminus, wherein the second oligonucleotide strand is sufficiently complementary to a target MET mRNA sequence selected from Tables 17 and 18 along at least 19 nucleotides of the second oligonucleotide strand length to reduce MET target gene expression when the double stranded nucleic acid is introduced into a mammalian cell.

In one embodiment, the second oligonucleotide is sufficiently complementary to a target MET mRNA sequence selected from Tables 17 and 18, along at least 20 nucleotides, for example, 20, 21, 22, 23, 24, 25, 26 or 27 nucleotides of the second oligonucleotide length.

The invention also provides for isolated double stranded ribonucleic acid (dsNA) comprising first and second nucleic acid strands and a duplex region of at least 25 base pairs, wherein the first strand is 25-34 nucleotides in length and the second strand of the dsNA is 26-35 nucleotides in length and comprises 1-5 single-stranded nucleotides at its 3' terminus, wherein the 3' terminus of the first oligonucleotide strand and the 5' terminus of the second oligonucleotide strand form a blunt end, and the second oligonucleotide strand is sufficiently complementary to a target MET mRNA sequence selected from the group consisting of SEQ ID NOs: 1441-1800 along at least 19 nucleotides of the second oligonucleotide strand length to reduce MET mRNA expression when the double stranded nucleic acid is introduced into a mammalian cell.

The invention also provides for isolated double stranded ribonucleic acid (dsNA) comprising first and second nucleic acid strands and a duplex region of at least 25 base pairs, wherein the first strand is 25-34 nucleotides in length and the second strand of the dsNA is 26-35 nucleotides in length and comprises 1-5 single-stranded nucleotides at its 3' terminus, wherein the 3' terminus of the first oligonucleotide strand and the 5' terminus of the second oligonucleotide strand form a blunt end, and the second oligonucleotide strand is sufficiently complementary to a target MET mRNA sequence selected from the group consisting of SEQ ID NOs: 1441-1800 along at least 20 nucleotides, for example, 20, 21, 22, 23, 24, 25, 26 or 27 nucleotides of the second oligonucleotide strand length to reduce MET mRNA expression when the double stranded nucleic acid is introduced into a mammalian cell.

In one embodiment, the isolated dsNA of the invention comprises a duplex region of at least 25 base pairs.

In another embodiment, the second oligonucleotide strand comprises 1-5 single-stranded nucleotides at its 3' terminus.

In another embodiment, the first strand is 25-35 nucleotides in length.

In another embodiment, the second strand is 25-35 nucleotides in length.

In another embodiment, the second oligonucleotide strand is complementary to a target MET cDNA sequence selected from the group consisting of GenBank Accession Nos. NM_001127500.1, NM_000245.2 and NM_008591.2 along at most 27 nucleotides of the second oligonucleotide strand length.

In another embodiment, starting from the first nucleotide (position 1) at the 3' terminus of the first oligonucleotide strand, position 1, 2 and/or 3 is substituted with a modified nucleotide.

In another embodiment, the 3' terminus of the first strand and the 5' terminus of the second strand form a blunt end.

In another embodiment, the first strand is 25 nucleotides in length and the second strand is 27 nucleotides in length.

In another embodiment, starting from the 5' end of a MET mRNA sequence selected from Table 15 (position 1), mammalian Ago2 cleaves the mRNA at a site between positions 9 and 10 of the sequence, thereby reducing MET target mRNA expression when the double stranded nucleic acid is introduced into a mammalian cell.

In another embodiment, starting from the 5' end of the MET mRNA sequence selected from Table 17 (position 1), mammalian Ago2 cleaves the mRNA at a site between positions 9 and 10 of the sequence, thereby reducing MET target mRNA expression when the double stranded nucleic acid is introduced into a mammalian cell.

In another embodiment, starting from the 5' end of the MET mRNA sequence selected from SEQ ID NOs: 1441-1800, mammalian Ago2 cleaves the mRNA at a site between positions 9 and 10 of the sequence, thereby reducing MET target mRNA expression when the double stranded nucleic acid is introduced into a mammalian cell.

In another embodiment, the second strand comprises a sequence selected from the group consisting of SEQ ID NOs: 361-720.

In another embodiment, the first strand comprises a sequence selected from the group consisting of SEQ ID NOs: 1-360.

In another embodiment, the dsNA of the invention comprises a pair of first strand/second strand sequences selected from Table 2.

In another embodiment, each of the first and the second strands has a length which is at least 26 nucleotides.

In another embodiment, the modified nucleotide residue of the 3' terminus of the first strand is selected from the group consisting of a deoxyribonucleotide, an acyclonucleotide and a fluorescent molecule.

In another embodiment, position 1 of the 3' terminus of the first oligonucleotide strand is a deoxyribonucleotide.

In another embodiment, the nucleotides of the 1-5 single-stranded nucleotides of the 3' terminus of the second strand comprise a modified nucleotide.

In another embodiment, the modified nucleotide of the 1-5 single-stranded nucleotides of the 3' terminus of the second strand is a 2'-O-methyl ribonucleotide.

In another embodiment, all nucleotides of the 1-5 single-stranded nucleotides of the 3' terminus of the second strand are modified nucleotides.

In another embodiment, the dsNA comprises a modified nucleotide.

In another embodiment, the modified nucleotide residue is selected from the group consisting of 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2) 2-O-2'-bridge, 2'-LNA, 2'-amino and 2'-O—(N-methlycarbamate).

In another embodiment, the 1-5 single-stranded nucleotides of the 3' terminus of the second strand are 1-3 nucleotides in length.

In another embodiment, the 1-5 single-stranded nucleotides of the 3' terminus of the second strand are 1-2 nucleotides in length.

In another embodiment, the 1-5 single-stranded nucleotides of the 3' terminus of the second strand is two nucleotides in length and comprises a 2'-O-methyl modified ribonucleotide.

In another embodiment, the second oligonucleotide strand comprises a modification pattern selected from the group consisting of AS-M1 to AS-M46.

In another embodiment, the first oligonucleotide strand comprises a modification pattern selected from the group consisting of SM1 to SM22.

In another embodiment, each of the first and the second strands has a length which is at least 26 and at most 30 nucleotides.

In another embodiment, the dsNA is cleaved endogenously in the cell by Dicer.

In another embodiment, the amount of the isolated double stranded nucleic acid sufficient to reduce expression of the target gene is selected from the group consisting of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of the cell.

In another embodiment, the isolated dsNA possesses greater potency than an isolated 21mer siRNA directed to the identical at least 19 nucleotides of the target MET mRNA in reducing target MET mRNA expression when assayed in vitro in a mammalian cell at an effective concentration in the environment of a cell of 1 nanomolar or less.

In another embodiment, the isolated dsNA is sufficiently complementary to the target MET mRNA sequence to reduce MET target mRNA expression by an amount (expressed by %) selected from the group consisting of at least 10%, at least 50%, at least 80-90%, at least 95%, at least 98%, and at least 99% when the double stranded nucleic acid is introduced into a mammalian cell.

In another embodiment, the first and second strands are joined by a chemical linker.

In another embodiment, the 3' terminus of the first strand and the 5' terminus of the second strand are joined by a chemical linker.

In another embodiment, a nucleotide of the second or first strand is substituted with a modified nucleotide that directs the orientation of Dicer cleavage.

In another embodiment, the dsNA of the invention comprises a modified nucleotide selected from the group consisting of a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, and a locked nucleic acid.

In another embodiment, the isolated double stranded nucleic acid of the invention comprises a phosphate backbone modification selected from the group consisting of a phosphonate, a phosphorothioate and a phosphotriester.

In another embodiment, the isolated double stranded nucleic acid of the invention comprises a modification selected from the group consisting of a morpholino nucleic acid and a peptide nucleic acid (PNA).

The invention also provides for a method for reducing expression of a target MET gene in a mammalian cell comprising contacting a mammalian cell in vitro with an isolated dsNA of any of claims 1-43 in an amount sufficient to reduce expression of a target MET mRNA in the cell.

In another embodiment, the target MET mRNA expression is reduced by an amount (expressed by %) selected from the group consisting of at least 10%, at least 50% and at least 80-90%.

In another embodiment, the MET mRNA levels are reduced by an amount (expressed by %) of at least 90% at least 8 days after the cell is contacted with the dsNA.

In another embodiment, the MET mRNA levels are reduced by an amount (expressed by %) of at least 70% at least 10 days after the cell is contacted with the dsNA.

The invention also provides for a method for reducing expression of a target MET mRNA in a mammal comprising administering an isolated dsNA of any of claims 1-43 to a mammal in an amount sufficient to reduce expression of a target MET mRNA in the mammal.

In another embodiment, the isolated dsNA is administered at a dosage selected from the group consisting of 1 microgram to 5 milligrams per kilogram of the mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, and 0.1 to 2.5 micrograms per kilogram.

In another embodiment, the isolated dsNA possesses greater potency than isolated 21mer siRNAs directed to the identical at least 19 nucleotides of the target MET mRNA in reducing target MET mRNA expression when assayed in vitro in a mammalian cell at an effective concentration in the environment of a cell of 1 nanomolar or less.

In another embodiment, the administering step comprises a mode selected from the group consisting of intravenous injection, intramuscular injection, intraperitoneal injection, infusion, subcutaneous injection, transdermal, aerosol, rectal, vaginal, topical, oral and inhaled delivery.

The invention also provides for a method for selectively inhibiting the growth of a cell comprising contacting a cell with an amount of an isolated dsNA of any of claims 1-43 sufficient to inhibit the growth of the cell.

In another embodiment, the cell is a tumor cell of a subject.

In another embodiment, the cell is a tumor cell in vitro.

In another embodiment, the cell is a human cell.

The invention also provides for a formulation comprising the isolated dsNA of any of claims 1-43, wherein the dsNA is present in an amount effective to reduce target MET mRNA levels when the dsNA is introduced into a mammalian cell in vitro by an amount (expressed by %) selected from the group consisting of at least 10%, at least 50% and at least 80-90%.

In another embodiment, the effective amount is selected from the group consisting of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of the cell.

The invention also provides for a formulation comprising the isolated dsNA of any of claims 3-43, wherein the dsNA is present in an amount effective to reduce target MET mRNA levels when the dsNA is introduced into a cell of a mammalian subject by an amount (expressed by %) selected from the group consisting of at least 10%, at least 50% and at least 80-90%.

In another embodiment, the effective amount is a dosage selected from the group consisting of 1 microgram to 5 milligrams per kilogram of the subject per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, and 0.1 to 2.5 micrograms per kilogram.

In another embodiment, the dsNA possesses greater potency than an isolated 21mer siRNA directed to the identical at least 19 nucleotides of the target MET mRNA in reducing target MET mRNA levels when assayed in vitro in a mammalian cell at an effective concentration in the environment of a cell of 1 nanomolar or less.

The invention also provides for a mammalian cell containing the isolated dsNA of any of claims 1-43.

The invention also provides for a pharmaceutical composition comprising the isolated dsNA of any of claims 1-43 and a pharmaceutically acceptable carrier.

The invention also provides for a kit comprising the isolated dsNA of any of claims 1-43 and instructions for its use.

The invention also provides for a method for treating or preventing a MET-associated disease or disorder in a subject comprising administering the isolated dsNA of any of claims 1-43 and a pharmaceutically acceptable carrier to the subject in an amount sufficient to treat or prevent the MET-associated disease or disorder in the subject, thereby treating or preventing the MET-associated disease or disorder in the subject.

In one embodiment, the MET-associated disease or disorder is selected from the group consisting of renal, breast, lung, liver, ovarian, cervical, esophageal, oropharyngeal and pancreatic cancer.

The invention also provides for a composition possessing MET inhibitory activity consisting essentially of an isolated double stranded ribonucleic acid (dsNA) of any of claims 1-43.

The present invention is also directed to compounds, compositions, and methods relating to traits, diseases and conditions that respond to the modulation of expression and/or activity of genes involved in MET gene expression pathways or other cellular processes that mediate the maintenance or development of such traits, diseases and conditions. In certain aspects, the invention relates to small nucleic acid molecules that are capable of being processed by the Dicer enzyme, such as Dicer substrate siRNAs (DsiRNAs) capable of mediating RNA interference (RNAi) against MET gene expression. The anti-MET dsRNAs of the invention are useful, for example, in providing compositions for treatment of traits, diseases and conditions that can respond to modulation of MET in a subject, such as cancer and/or other proliferative diseases, disorders, or conditions. Efficacy, potency, toxicity and other effects of an anti-MET dsRNA can be examined in one or more animal models of proliferative disease (exemplary animal models of proliferative disease are recited below).

BRIEF DESCRIPTION OF THE DRAWINGS

FIGS. 2-1 to 2-4 present primary screen data showing DsiRNA-mediated knockdown of human MET (FIGS. 2-1 and 2-2) and mouse MET (FIGS. 2-3 and 2-4) in human and mouse cells, respectively. For each DsiRNA tested, two independent qPCR amplicons were assayed (in human cells, amplicons "1548-1708" and "5621-5785" were assayed, while in mouse cells, amplicons "230-363" and "5969-6087" were assayed). The indicated region of FIG. 2-4 identifies a series of assays known to have been affected by sub-optimal transfection conditions.

FIGS. 3-1 to 3-4 show histograms of human and mouse MET inhibitory efficacies observed for indicated DsiRNAs. "P1" indicates phase 1 (primary screen), while "P2" indicates phase 2. In phase 1, DsiRNAs were tested at 1 nM in the environment of HeLa cells (human cell assays; FIGS. 3-1 and 3-2) or mouse cells (Hepa1-6 cell assays; FIGS. 3-3 and 3-4). In phase 2, DsiRNAs were tested at 1 nM, and at 0.1 nM in the environment of HeLa cells. Individual bars represent average human (FIGS. 3-1 and 3-2) or mouse (FIGS. 3-3 and 3-4) MET levels observed in triplicate, with standard errors shown. Human MET levels were normalized to HPRT and SFRS9 levels, while mouse MET levels were normalized to HPRT and Rpl23 levels.

FIGS. 4-1 to 4-49 present bar graphs showing efficacy data for four different 2'-O-methyl modification patterns ("M12", "M8", "M3" and "M1", respectively, as shown in FIG. 4-1) each across 24 MET-targeting DsiRNAs in human HeLa cells (FIGS. 4-2 to 4-25) and mouse Hepa 1-6 cells (FIGS. 4-26 to 4-49) at 0.1 nM (duplicate assays) and 1 nM.

FIGS. 5-1 to 5-7 present bar graphs showing efficacy data for exemplary duplexes possessing 2'-O-methyl modification patterns of both guide and passenger strands (duplex modification patterns are shown in FIGS. 5-1 to 5-3). Four modified forms of each of 24 MET-targeting duplex sequences were synthesized and examined for MET reducing efficacy in human HeLa cells (FIGS. 5-4 to 5-7) at 0.1 nM (duplicate assays) and 1 nM.

FIG. 6 shows MET knockdown $IC_{50}$ curves obtained for eight DsiRNAs (MET-2113, MET-4559, MET-4947, MET-5094, MET-5357, MET-5946, MET-6307 and MET-6520) in HeLa cells. Assays were performed at 24 hours post-transfection, and all duplexes possessed an "M39" 2'-O-Methyl guide strand modification pattern.

FIG. 7 shows MET knockdown $IC_{50}$ curves obtained for eight additional DsiRNAs (MET-1040-M12, MET-1042-M37, MET-2864-M37, MET-2882-M12, MET-3158-M1, MET-3158-M12, MET-3488-M1 and MET-3488-M12) in HeLa cells. Assays were performed at 24 hours post-transfection, with duplexes possessing 2'-O-Methyl modified guide strands as indicated.

FIG. 8 shows MET knockdown $IC_{50}$ curves obtained for a MET-2864 DsiRNA sequence possessing the five guide strand modification patterns indicated at bottom, in HeLa cells. Assays were performed at 24 hours post-transfection, and a relatively highly modified duplex ("M37") showed the lowest measured $IC_{50}$ value (20.35 pM).

FIG. 9 shows relative levels of MET protein expression in HeLa, Hepa1-6, Hep3B, HepG2 and Huh7 cells, and in normal mouse liver, spleen and lung tissues. Western assays were performed and tubulin levels are shown for normalization purposes.

FIG. 10 demonstrates that MET mRNA and protein knockdown levels directly correlated. Top panels show $IC_{50}$ traces for MET mRNA knockdown produced by MET-4559, MET-5094 and MET-5357 DsiRNAs, in HeLa cells harvested at 24 hours post-DsiRNA administration. Bottom panels show western blot results for MET and Vinculin (control protein) in HeLa cells harvested at 48 hours after indicated DsiRNA administration at 10 nM, 1 nM or 0.1 nM (initially transfected at t=0 and re-transfected at t=24 hours).

FIG. 11 shows that MET mRNA and protein knockdown levels directly correlated for MET DsiRNAs possessing modified guide strands. The histogram at top shows MET mRNA knockdown observed for HeLa cells treated with MET-1012-M39, MET-1042-M39, MET-2864-M39, MET-1042-M8 and MET-2864-M5 DsiRNAs, assayed at 24 hours post-transfection. Bottom panels show western blot results for Met and Vinculin (control protein) in HeLa cells harvested at 48 hours after these DsiRNAs were administered at 10 nM, 1 nM or 0.1 nM (initially transfected at t=0 and re-transfected at t=24 hours).

FIG. 12 demonstrates that DsiRNAs MET-1040-M12, MET-2882-M12, MET-3158-M12, MET-3158-M1, MET-3488-M12 and MET-3488-M1 significantly reduced Met protein levels in HeLa cells western blotted to detect Met and Vinculin (control protein) at 48 hours after these DsiR-NAs were administered at 10 nM, 1 nM or 0.1 nM.

FIG. 13 shows that DsiRNAs MET-1042-M37 and MET-3488-M1 significantly reduced MET mRNA levels (by greater than 70%) in mouse livers harvested 72 hours after DsiRNA dosing. DsiRNAs were administered at 10 mg/kg in Invivofectamine® 2.0 and results of left and right panels were obtained using two distinct probes for MET mRNA. The MYC-97-M24 DsiRNA was included as a non-MET-targeting control.

FIG. 14 demonstrates that DsiRNAs MET-1042-M37, MET-2864-M37, MET-1040-M12, MET-2882-M12, MET-3158-M12, MET-3158-M1 and MET-3488-M12 significantly reduced MET mRNA levels in mouse livers harvested 48 hours after DsiRNA dosing. DsiRNAs were administered at 10 mg/kg in Invivofectamine® 2.0 and results of left and right panels reflect normalization to HPRT and GAPDH control mRNAs, respectively.

DETAILED DESCRIPTION OF THE INVENTION

Figure 1:
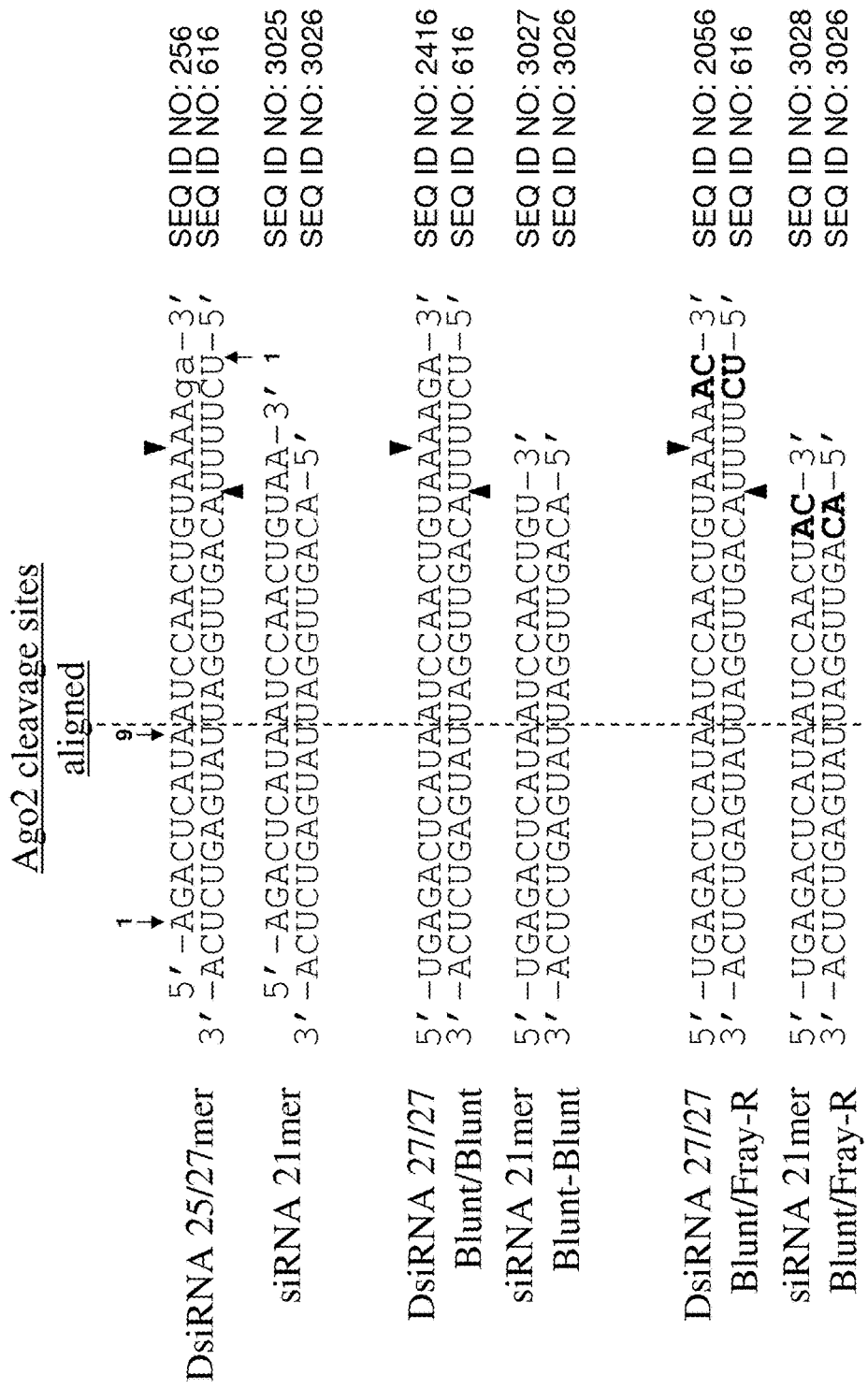
FIG. 1 shows the structures of exemplary DsiRNA agents of the invention targeting a site in the MET RNA referred to herein as the "MET-3780" target site. UPPER case=unmodified RNA, lower case=DNA, Bold=mismatch base pair nucleotides; arrowheads indicate projected Dicer enzyme cleavage sites; dashed line indicates sense strand (top strand) sequences corresponding to the projected Argonaute 2 (Ago2) cleavage site within the targeted MET sequence.

The present invention is directed to compositions that contain double stranded RNA ("dsRNA"), and methods for preparing them, that are capable of reducing the level and/or expression of the MET gene in vivo or in vitro. One of the strands of the dsRNA contains a region of nucleotide sequence that has a length that ranges from 19 to 35 nucleotides that can direct the destruction and/or translational inhibition of the targeted MET transcript.

Definitions

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). As used herein, the following terms have the meanings ascribed to them below, unless specified otherwise.

The present invention features one or more DsiRNA molecules that can modulate (e.g., inhibit) MET expression. The DsiRNAs of the invention optionally can be used in combination with modulators of other genes and/or gene products associated with the maintenance or development of diseases or disorders associated with MET misregulation (e.g., tumor formation and/or growth, etc.). The DsiRNA agents of the invention modulate MET RNAs such as those corresponding to the cDNA sequences referred to by Gen-Bank Accession Nos. NM_001127500.1 (human MET, transcript variant 1), NM_000245.2 (human MET, transcript variant 2) and NM_008591.2 (mouse MET), which are referred to herein generally as "MET."

The below description of the various aspects and embodiments of the invention is provided with reference to exemplary MET RNAs, generally referred to herein as MET. However, such reference is meant to be exemplary only and the various aspects and embodiments of the invention are also directed to alternate MET RNAs, such as mutant MET RNAs or additional MET splice variants. Certain aspects and embodiments are also directed to other genes involved in MET pathways, including genes whose misregulation acts in association with that of MET (or is affected or affects MET regulation) to produce phenotypic effects that may be targeted for treatment (e.g., tumor formation and/or growth, etc.). (The Ras, Beta-Catenin (Wnt signaling), STAT, PI3K and Notch pathways are examples of pathways for which misregulation of genes can act in association with that of MET.) Such additional genes can be targeted using dsRNA and the methods described herein for use of MET targeting dsRNAs. Thus, the inhibition and the effects of such inhibition of the other genes can be performed as described herein.

The term "MET" refers to nucleic acid sequences encoding a MET protein, peptide, or polypeptide (e.g., MET transcripts, such as the sequences of MET Genbank Accession Nos. NM_001127500.1, NM_000245.2 and NM_008591.2). In certain embodiments, the term "MET" is also meant to include other MET encoding sequence, such as other MET isoforms, mutant MET genes, splice variants of MET genes, and MET gene polymorphisms. The term "MET" is also used to refer to the polypeptide gene product of a MET gene/transript, e.g., a MET protein, peptide, or polypeptide, such as those encoded by MET Genbank Accession Nos. NM_001127500.1, NM_000245.2 and NM_008591.2.

As used herein, a "MET-associated disease or disorder" refers to a disease or disorder known in the art to be associated with altered MET expression, level and/or activity. Notably, a "MET-associated disease or disorder" includes cancer and/or proliferative diseases, conditions, or disorders. Certain exemplary "MET-associated disease or disorders" include hepatocellular carcinoma (HCC), lung cancer (e.g., NSCLC), colorectal cancer, prostate cancer, pancreatic cancer, ovarian cancer, liver cancer, brain cancer (e.g., glioblastoma), renal cancer (e.g., papillary renal carcinoma), stomach cancer, esophageal cancer, medulloblastoma, thyroid carcinoma, rhabdomyosarcoma, osteosarcoma, squamous cell carcinoma (e.g., oral squamous cell carcinoma), melanoma and breast cancer. Other hyperproliferative diseases or disorders may also be targeted, including, e.g., bladder, cervical (uterine), endometrial (uterine), head and neck, and oropharyngeal cancers.

By "proliferative disease" or "cancer" as used herein is meant, a disease, condition, trait, genotype or phenotype characterized by unregulated cell growth or replication as is known in the art; including hepatocellular carcinoma (HCC), leukemias, for example, acute myelogenous leukemia (AML), chronic myelogenous leukemia (CML), acute lymphocytic leukemia (ALL), and chronic lymphocytic leukemia, AIDS related cancers such as Kaposi's sarcoma; breast cancers; bone cancers such as Osteosarcoma, Chondrosarcomas, Ewing's sarcoma, Fibrosarcomas, Giant cell tumors, Adamantinomas, and Chordomas; Brain cancers such as Meningiomas, Glioblastomas, Lower-Grade Astrocytomas, Oligodendrocytomas, Pituitary Tumors, Schwannomas, and Metastatic brain cancers; cancers of the head and neck including various lymphomas such as mantle cell lymphoma, non-Hodgkins lymphoma, adenoma, squamous cell carcinoma, laryngeal carcinoma, gallbladder and bile duct cancers, cancers of the retina such as retinoblastoma, cancers of the esophagus, gastric cancers, multiple myeloma, ovarian cancer, uterine cancer, thyroid cancer, testicular cancer, endometrial cancer, melanoma, colorectal cancer, bladder cancer, prostate cancer, lung cancer (including non-small cell lung carcinoma), pancreatic cancer, sarcomas, Wilms' tumor, cervical cancer, head and neck cancer, skin cancers, nasopharyngeal carcinoma, liposarcoma, epithelial carcinoma, renal cell carcinoma, gallbladder adeno carcinoma, parotid adenocarcinoma, endometrial sarcoma, multidrug resistant cancers; and proliferative diseases and conditions, such as neovascularization associated with tumor angiogenesis, macular degeneration (e.g., wet/dry AMD), corneal neovascularization, diabetic retinopathy, neovascular glaucoma, myopic degeneration and other proliferative diseases and conditions such as restenosis and polycystic kidney disease, and other cancer or proliferative disease, condition, trait, genotype or phenotype that can respond to the modulation of disease related gene expression in a cell or tissue, alone or in combination with other therapies.

In certain embodiments, dsRNA-mediated inhibition of a MET target sequence is assessed. In such embodiments, MET RNA levels can be assessed by art-recognized methods (e.g., RT-PCR, Northern blot, expression array, etc.), optionally via comparison of MET levels in the presence of an anti-MET dsRNA of the invention relative to the absence of such an anti-MET dsRNA. In certain embodiments, MET levels in the presence of an anti-MET dsRNA are compared to those observed in the presence of vehicle alone, in the presence of a dsRNA directed against an unrelated target RNA, or in the absence of any treatment.

It is also recognized that levels of MET protein can be assessed and that MET protein levels are, under different conditions, either directly or indirectly related to MET RNA levels and/or the extent to which a dsRNA inhibits MET expression, thus art-recognized methods of assessing MET protein levels (e.g., Western blot, immunoprecipitation, other antibody-based methods, etc.) can also be employed to examine the inhibitory effect of a dsRNA of the invention.

An anti-MET dsRNA of the invention is deemed to possess "MET inhibitory activity" if a statistically significant reduction in MET RNA (or when the MET protein is assessed, MET protein levels) is seen when an anti-MET dsRNA of the invention is administered to a system (e.g., cell-free in vitro system), cell, tissue or organism, as compared to a selected control. The distribution of experimental values and the number of replicate assays performed will tend to dictate the parameters of what levels of reduction in MET RNA (either as a % or in absolute terms) is deemed statistically significant (as assessed by standard methods of determining statistical significance known in the art). However, in certain embodiments, "MET inhibitory activity" is defined based upon a % or absolute level of reduction in the level of MET in a system, cell, tissue or organism. For example, in certain embodiments, a dsRNA of the invention is deemed to possess MET inhibitory activity if at least a 5% reduction or at least a 10% reduction in MET RNA is observed in the presence of a dsRNA of the invention relative to MET levels seen for a suitable control. (For example, in vivo MET levels in a tissue and/or subject can, in certain embodiments, be deemed to be inhibited by a dsRNA agent of the invention if, e.g., a 5% or 10% reduction in MET levels is observed relative to a control.) In certain other embodiments, a dsRNA of the invention is deemed to possess MET inhibitory activity if MET RNA levels are observed to be reduced by at least 15% relative to a selected control, by at least 20% relative to a selected control, by at least 25% relative to a selected control, by at least 30% relative to a selected control, by at least 35% relative to a selected control, by at least 40% relative to a selected control, by at least 45% relative to a selected control, by at least 50% relative to a selected control, by at least 55% relative to a selected control, by at least 60% relative to a selected control, by at least 65% relative to a selected control, by at least 70% relative to a selected control, by at least 75% relative to a selected control, by at least 80% relative to a selected control, by at least 85% relative to a selected control, by at least 90% relative to a selected control, by at least 95% relative to a selected control, by at least 96% relative to a selected control, by at least 97% relative to a selected control, by at least 98% relative to a selected control or by at least 99% relative to a selected control. In some embodiments, complete inhibition of MET is required for a dsRNA to be deemed to possess MET inhibitory activity. In certain models (e.g., cell culture), a dsRNA is deemed to possess MET inhibitory activity if at least a 50% reduction in MET levels is observed relative to a suitable control. In certain other embodiments, a dsRNA is deemed to possess MET inhibitory activity if at least an 80% reduction in MET levels is observed relative to a suitable control.

By way of specific example, in Example 2 below, a series of DsiRNAs targeting MET were tested for the ability to reduce MET mRNA levels in human HeLa or mouse Hepa 1-6 cells in vitro, at 1 nM concentrations in the environment of such cells and in the presence of a transfection agent (Lipofectamine™ RNAiMAX, Invitrogen). Within Example 2 below, MET inhibitory activity was ascribed to those DsiRNAs that were observed to effect at least a 70% reduction of MET mRNA levels under the assayed conditions. It is contemplated that MET inhibitory activity could also be attributed to a dsRNA under either more or less stringent conditions than those employed for Example 2 below, even when the same or a similar assay and conditions are employed. For example, in certain embodiments, a tested dsRNA of the invention is deemed to possess MET inhibitory activity if at least a 10% reduction, at least a 20% reduction, at least a 30% reduction, at least a 40% reduction, at least a 50% reduction, at least a 60% reduction, at least a 75% reduction, at least an 80% reduction, at least an 85% reduction, at least a 90% reduction, or at least a 95% reduction in MET mRNA levels is observed in a mammalian cell line in vitro at 1 nM dsRNA concentration or lower in the environment of a cell, relative to a suitable control.

Use of other endpoints for determination of whether a double stranded RNA of the invention possesses MET inhibitory activity is also contemplated. Specifically, in one embodiment, in addition to or as an alternative to assessing MET mRNA levels, the ability of a tested dsRNA to reduce MET protein levels (e.g., at 48 hours after contacting a mammalian cell in vitro or in vivo) is assessed, and a tested dsRNA is deemed to possess MET inhibitory activity if at least a 10% reduction, at least a 20% reduction, at least a 30% reduction, at least a 40% reduction, at least a 50% reduction, at least a 60% reduction, at least a 70% reduction, at least a 75% reduction, at least an 80% reduction, at least an 85% reduction, at least a 90% reduction, or at least a 95% reduction in MET protein levels is observed in a mammalian cell contacted with the assayed double stranded RNA in vitro or in vivo, relative to a suitable control. Additional endpoints contemplated include, e.g., assessment of a phenotype associated with reduction of MET levels—e.g., reduction of growth of a contacted mammalian cell line in vitro and/or reduction of growth of a tumor in vivo, including, e.g., halting or reducing the growth of tumor or cancer cell levels as described in greater detail elsewhere herein.

MET inhibitory activity can also be evaluated over time (duration) and over concentration ranges (potency), with assessment of what constitutes a dsRNA possessing MET inhibitory activity adjusted in accordance with concentrations administered and duration of time following administration. Thus, in certain embodiments, a dsRNA of the invention is deemed to possess MET inhibitory activity if at least a 50% reduction in MET activity is observed/persists at a duration of time of 2 hours, 5 hours, 10 hours, 1 day, 2 days, 3 days, 4 days, 5 days, 6 days, 7 days, 8 days, 9 days, 10 days or more after administration of the dsRNA to a cell or organism. In additional embodiments, a dsRNA of the invention is deemed to be a potent MET inhibitory agent if MET inhibitory activity (e.g., in certain embodiments, at least 50% inhibition of MET) is observed at a concentration of 1 nM or less, 500 pM or less, 200 pM or less, 100 pM or less, 50 pM or less, 20 pM or less, 10 pM or less, 5 pM or less, 2 pM or less or even 1 pM or less in the environment of a cell, for example, within an in vitro assay for MET inhibitory activity as described herein. In certain embodiments, a potent MET inhibitory dsRNA of the invention is defined as one that is capable of MET inhibitory activity (e.g., in certain embodiments, at least 20% reduction of MET levels) at a formulated concentration of 10 mg/kg or less when administered to a subject in an effective delivery vehicle (e.g., an effective lipid nanoparticle formulation). Preferably, a potent MET inhibitory dsRNA of the invention is defined as one that is capable of MET inhibitory activity (e.g., in certain embodiments, at least 50% reduction of MET levels) at a formulated concentration of 5 mg/kg or less when administered to a subject in an effective delivery vehicle. More preferably, a potent MET inhibitory dsRNA of the invention is defined as one that is capable of MET inhibitory activity (e.g., in certain embodiments, at least 50% reduction of MET levels) at a formulated concentration of 5 mg/kg or less when administered to a subject in an effective delivery vehicle. Optionally, a potent MET inhibitory dsRNA of the invention is defined as one that is capable of MET inhibitory activity (e.g., in certain embodiments, at least 50% reduction of MET levels) at a formulated concentration of 2 mg/kg or less, or even 1 mg/kg or less, when administered to a subject in an effective delivery vehicle.

In certain embodiments, potency of a dsRNA of the invention is determined in reference to the number of copies of a dsRNA present in the cytoplasm of a target cell that are required to achieve a certain level of target gene knockdown. For example, in certain embodiments, a potent dsRNA is one capable of causing 50% or greater knockdown of a target mRNA when present in the cytoplasm of a target cell at a copy number of 1000 or fewer RISC-loaded antisense strands per cell. More preferably, a potent dsRNA is one capable of producing 50% or greater knockdown of a target mRNA when present in the cytoplasm of a target cell at a copy number of 500 or fewer RISC-loaded antisense strands per cell. Optionally, a potent dsRNA is one capable of producing 50% or greater knockdown of a target mRNA when present in the cytoplasm of a target cell at a copy number of 300 or fewer RISC-loaded antisense strands per cell.

In further embodiments, the potency of a DsiRNA of the invention can be defined in reference to a 19 to 23mer dsRNA directed to the same target sequence within the same target gene. For example, a DsiRNA of the invention that possesses enhanced potency relative to a corresponding 19 to 23mer dsRNA can be a DsiRNA that reduces a target gene by an additional 5% or more, an additional 10% or more, an additional 20% or more, an additional 30% or more, an additional 40% or more, or an additional 50% or more as compared to a corresponding 19 to 23mer dsRNA, when assayed in an in vitro assay as described herein at a sufficiently low concentration to allow for detection of a potency difference (e.g., transfection concentrations at or below 1 nM in the environment of a cell, at or below 100 pM in the environment of a cell, at or below 10 pM in the environment of a cell, at or below 1 nM in the environment of a cell, in an in vitro assay as described herein; notably, it is recognized that potency differences can be best detected via performance of such assays across a range of concentrations—e.g., 0.1 pM to 10 nM—for purpose of generating a dose-response curve and identifying an $IC_{50}$ value associated with a DsiRNA/dsRNA).

MET inhibitory levels and/or MET levels may also be assessed indirectly, e.g., measurement of a reduction of the size, number and/or rate of growth or spread of polyps or tumors in a subject may be used to assess MET levels and/or MET inhibitory efficacy of a double-stranded nucleic acid of the instant invention.

In certain embodiments, the phrase "consists essentially of" is used in reference to the anti-MET dsRNAs of the invention. In some such embodiments, "consists essentially of" refers to a composition that comprises a dsRNA of the invention which possesses at least a certain level of MET inhibitory activity (e.g., at least 50% MET inhibitory activity) and that also comprises one or more additional components and/or modifications that do not significantly impact the MET inhibitory activity of the dsRNA. For example, in certain embodiments, a composition "consists essentially of" a dsRNA of the invention where modifications of the dsRNA of the invention and/or dsRNA-associated components of the composition do not alter the MET inhibitory activity (optionally including potency or duration of MET inhibitory activity) by greater than 3%, greater than 5%, greater than 10%, greater than 15%, greater than 20%, greater than 25%, greater than 30%, greater than 35%, greater than 40%, greater than 45%, or greater than 50% relative to the dsRNA of the invention in isolation. In certain embodiments, a composition is deemed to consist essentially of a dsRNA of the invention even if more dramatic reduction of MET inhibitory activity (e.g., 80% reduction, 90% reduction, etc. in efficacy, duration and/or potency) occurs in the presence of additional components or modifications, yet where MET inhibitory activity is not significantly elevated (e.g., observed levels of MET inhibitory activity are within 10% those observed for the isolated dsRNA of the invention) in the presence of additional components and/or modifications.

As used herein, the term "nucleic acid" refers to deoxyribonucleotides, ribonucleotides, or modified nucleotides, and polymers thereof in single- or double-stranded form. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2-O-methyl ribonucleotides, peptide-nucleic acids (PNAs) and unlocked nucleic acids (UNAs; see, e.g., Jensen et al. *Nucleic Acids Symposium Series* 52: 133-4), and derivatives thereof.

As used herein, "nucleotide" is used as recognized in the art to include those with natural bases (standard), and modified bases well known in the art. Such bases are generally located at the 1' position of a nucleotide sugar moiety. Nucleotides generally comprise a base, sugar and a phosphate group. The nucleotides can be unmodified or modified at the sugar, phosphate and/or base moiety, (also referred to interchangeably as nucleotide analogs, modified nucleotides, non-natural nucleotides, non-standard nucleotides and other; see, e.g., Usman and McSwiggen, supra; Eckstein, et al., International PCT Publication No. WO 92/07065; Usman et al, International PCT Publication No. WO 93/15187; Uhlman & Peyman, supra, all are hereby incorporated by reference herein). There are several examples of modified nucleic acid bases known in the art as summarized by Limbach, et al, *Nucleic Acids Res.* 22:2183, 1994. Some of the non-limiting examples of base modifications that can be introduced into nucleic acid molecules include, hypoxanthine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), propyne, and others (Burgin, et al., Biochemistry 35:14090, 1996; Uhlman & Peyman, supra). By "modified bases" in this aspect is meant nucleotide bases other than adenine, guanine, cytosine and uracil at 1' position or their equivalents.

As used herein, "modified nucleotide" refers to a nucleotide that has one or more modifications to the nucleoside, the nucleobase, pentose ring, or phosphate group. For example, modified nucleotides exclude ribonucleotides containing adenosine monophosphate, guanosine monophosphate, uridine monophosphate, and cytidine monophosphate and deoxyribonucleotides containing deoxyadenosine monophosphate, deoxyguanosine monophosphate, deoxythymidine monophosphate, and deoxycytidine monophosphate. Modifications include those naturally occurring that result from modification by enzymes that modify nucleotides, such as methyltransferases. Modified nucleotides also include synthetic or non-naturally occurring nucleotides. Synthetic or non-naturally occurring modifications in nucleotides include those with 2' modifications, e.g., 2'-methoxyethoxy, 2'-fluoro, 2'-allyl, 2'-O-[2-(methylamino)-2-oxoethyl], 4'-thio, 4'-CH$_2$—O-2'-bridge, 4'-(CH$_2$)$_2$—O-2'-bridge, 2'-LNA or other bicyclic or "bridged" nucleoside analog, and 2'-O—(N-methylcarbamate) or those comprising base analogs. In connection with 2'-modified nucleotides as described for the present disclosure, by "amino" is meant 2'—NH$_2$ or 2'-O—NH$_2$, which can be modified or unmodified. Such modified groups are described, e.g., in Eckstein et al., U.S. Pat. No. 5,672,695 and Matulic-Adamic et al., U.S. Pat. No. 6,248,878. "Modified nucleotides" of the instant invention can also include nucleotide analogs as described above.

In reference to the nucleic acid molecules of the present disclosure, modifications may exist upon these agents in patterns on one or both strands of the double stranded ribonucleic acid (dsRNA). As used herein, "alternating positions" refers to a pattern where every other nucleotide is a modified nucleotide or there is an unmodified nucleotide (e.g., an unmodified ribonucleotide) between every modified nucleotide over a defined length of a strand of the dsRNA (e.g., 5'-MNMNMN-3'; 3'-MNMNMN-5'; where M is a modified nucleotide and N is an unmodified nucleotide). The modification pattern starts from the first nucleotide position at either the 5' or 3' terminus according to a position numbering convention, e.g., as described herein (in certain embodiments, position 1 is designated in reference to the terminal residue of a strand following a projected Dicer cleavage event of a DsiRNA agent of the invention; thus, position 1 does not always constitute a 3' terminal or 5' terminal residue of a pre-processed agent of the invention). The pattern of modified nucleotides at alternating positions may run the full length of the strand, but in certain embodiments includes at least 4, 6, 8, 10, 12, 14 nucleotides containing at least 2, 3, 4, 5, 6 or 7 modified nucleotides, respectively. As used herein, "alternating pairs of positions" refers to a pattern where two consecutive modified nucleotides are separated by two consecutive unmodified nucleotides over a defined length of a strand of the dsRNA (e.g., 5'-MMNNMMNNMMNN-3'; 3'-MMNNMMNNMMNN-5'; where M is a modified nucleotide and N is an unmodified nucleotide). The modification pattern starts from the first nucleotide position at either the 5' or 3' terminus according to a position numbering convention such as those described herein. The pattern of modified nucleotides at alternating positions may run the full length of the strand, but preferably includes at least 8, 12, 16, 20, 24, 28 nucleotides containing at least 4, 6, 8, 10, 12 or 14 modified nucleotides, respectively. It is emphasized that the above modification patterns are exemplary and are not intended as limitations on the scope of the invention.

As used herein, "base analog" refers to a heterocyclic moiety which is located at the 1' position of a nucleotide sugar moiety in a modified nucleotide that can be incorporated into a nucleic acid duplex (or the equivalent position in a nucleotide sugar moiety substitution that can be incorporated into a nucleic acid duplex). In the dsRNAs of the invention, a base analog is generally either a purine or pyrimidine base excluding the common bases guanine (G), cytosine (C), adenine (A), thymine (T), and uracil (U). Base analogs can duplex with other bases or base analogs in dsRNAs. Base analogs include those useful in the compounds and methods of the invention., e.g., those disclosed in U.S. Pat. Nos. 5,432,272 and 6,001,983 to Benner and US Patent Publication No. 20080213891 to Manoharan, which are herein incorporated by reference. Non-limiting examples of bases include hypoxanthine (I), xanthine (X), 313-D-ribofuranosyl-(2,6-diaminopyrimidine) (K), 3-γ-D-ribofuranosyl-(1-methyl-pyrazolo[4,3-d]pyrimidine-5,7(4H,6H)-dione) (P), iso-cytosine (iso-C), iso-guanine (iso-G), 1-γ-D-ribofuranosyl-(5-nitroindole), 1-γ-D-ribofuranosyl-(3-nitropyrrole), 5-bromouracil, 2-aminopurine, 4-thio-dT, 7-(2-thienyl)-imidazo[4,5-b]pyridine (Ds) and pyrrole-2-carbaldehyde (Pa), 2-amino-6-(2-thienyl)purine (S), 2-oxopyridine (Y), difluorotolyl, 4-fluoro-6-methylbenzimidazole, 4-methylbenzimidazole, 3-methyl isocarbostyrilyl, 5-methyl isocarbostyrilyl, and 3-methyl-7-propynyl isocarbostyrilyl, 7-azaindolyl, 6-methyl-7-azaindolyl, imidizopyridinyl, 9-methyl-imidizopyridinyl, pyrrolopyrizinyl, isocarbostyrilyl, 7-propynyl isocarbostyrilyl, propynyl-7-azaindolyl, 2,4,5-trimethylphenyl, 4-methylindolyl, 4,6-dimethylindolyl, phenyl, napthalenyl, anthracenyl, phenanthracenyl, pyrenyl, stilbenzyl, tetracenyl, pentacenyl, and structural derivates thereof (Schweitzer et al., J. Org. Chem., 59:7238-7242 (1994); Berger et al., Nucleic Acids Research, 28(15):2911-2914 (2000); Moran et al., J. Am. Chem. Soc., 119:2056-2057 (1997); Morales et al., J. Am. Chem. Soc., 121:2323-2324 (1999); Guckian et al., J. Am. Chem. Soc., 118:8182-8183 (1996); Morales et al., J. Am. Chem. Soc., 122(6):1001-1007 (2000); McMinn et al., J. Am. Chem. Soc., 121:11585-11586 (1999); Guckian et al., *J. Org. Chem.,* 63:9652-9656 (1998); Moran et al., Proc. Natl. Acad. Sci., 94:10506-10511 (1997); Das et al., J. Chem. Soc., Perkin Trans., 1:197-206 (2002); Shibata et al., J. Chem. Soc., Perkin Trans., 1: 1605-1611 (2001); Wu et al., J. Am. Chem. Soc., 122(32):7621-7632 (2000); O'Neill et al., J. Org. Chem., 67:5869-5875 (2002); Chaudhuri et al., J. Am.

Chem. Soc., 117:10434-10442 (1995); and U.S. Pat. No. 6,218,108.). Base analogs may also be a universal base.

As used herein, "universal base" refers to a heterocyclic moiety located at the 1' position of a nucleotide sugar moiety in a modified nucleotide, or the equivalent position in a nucleotide sugar moiety substitution, that, when present in a nucleic acid duplex, can be positioned opposite more than one type of base without altering the double helical structure (e.g., the structure of the phosphate backbone). Additionally, the universal base does not destroy the ability of the single stranded nucleic acid in which it resides to duplex to a target nucleic acid. The ability of a single stranded nucleic acid containing a universal base to duplex a target nucleic can be assayed by methods apparent to one in the art (e.g., UV absorbance, circular dichroism, gel shift, single stranded nuclease sensitivity, etc.). Additionally, conditions under which duplex formation is observed may be varied to determine duplex stability or formation, e.g., temperature, as melting temperature (Tm) correlates with the stability of nucleic acid duplexes. Compared to a reference single stranded nucleic acid that is exactly complementary to a target nucleic acid, the single stranded nucleic acid containing a universal base forms a duplex with the target nucleic acid that has a lower Tm than a duplex formed with the complementary nucleic acid. However, compared to a reference single stranded nucleic acid in which the universal base has been replaced with a base to generate a single mismatch, the single stranded nucleic acid containing the universal base forms a duplex with the target nucleic acid that has a higher Tm than a duplex formed with the nucleic acid having the mismatched base.

Some universal bases are capable of base pairing by forming hydrogen bonds between the universal base and all of the bases guanine (G), cytosine (C), adenine (A), thymine (T), and uracil (U) under base pair forming conditions. A universal base is not a base that forms a base pair with only one single complementary base. In a duplex, a universal base may form no hydrogen bonds, one hydrogen bond, or more than one hydrogen bond with each of G, C, A, T, and U opposite to it on the opposite strand of a duplex. Preferably, the universal bases does not interact with the base opposite to it on the opposite strand of a duplex. In a duplex, base pairing between a universal base occurs without altering the double helical structure of the phosphate backbone. A universal base may also interact with bases in adjacent nucleotides on the same nucleic acid strand by stacking interactions. Such stacking interactions stabilize the duplex, especially in situations where the universal base does not form any hydrogen bonds with the base positioned opposite to it on the opposite strand of the duplex. Non-limiting examples of universal-binding nucleotides include inosine, 1-γ-D-ribofuranosyl-5-nitroindole, and/or 1-γ-D-ribofuranosyl-3-nitropyrrole (US Pat. Appl. Publ. No. 20070254362 to Quay et al.; Van Aerschot et al., An acyclic 5-nitroindazole nucleoside analogue as ambiguous nucleoside. Nucleic Acids Res. 1995 Nov. 11; 23(21):4363-70; Loakes et al., 3-Nitropyrrole and 5-nitroindole as universal bases in primers for DNA sequencing and PCR. Nucleic Acids Res. 1995 Jul. 11; 23(13):2361-6; Loakes and Brown, 5-Nitroindole as an universal base analogue. Nucleic Acids Res. 1994 Oct. 11; 22(20):4039-43).

As used herein, "loop" refers to a structure formed by a single strand of a nucleic acid, in which complementary regions that flank a particular single stranded nucleotide region hybridize in a way that the single stranded nucleotide region between the complementary regions is excluded from duplex formation or Watson-Crick base pairing. A loop is a single stranded nucleotide region of any length. Examples of loops include the unpaired nucleotides present in such structures as hairpins, stem loops, or extended loops.

As used herein, "extended loop" in the context of a dsRNA refers to a single stranded loop and in addition 1, 2, 3, 4, 5, 6 or up to 20 base pairs or duplexes flanking the loop. In an extended loop, nucleotides that flank the loop on the 5' side form a duplex with nucleotides that flank the loop on the 3' side. An extended loop may form a hairpin or stem loop.

As used herein, "tetraloop" in the context of a dsRNA refers to a loop (a single stranded region) consisting of four nucleotides that forms a stable secondary structure that contributes to the stability of an adjacent Watson-Crick hybridized nucleotides. Without being limited to theory, a tetraloop may stabilize an adjacent Watson-Crick base pair by stacking interactions. In addition, interactions among the four nucleotides in a tetraloop include but are not limited to non-Watson-Crick base pairing, stacking interactions, hydrogen bonding, and contact interactions (Cheong et al., Nature 1990 Aug. 16; 346(6285):680-2; Heus and Pardi, Science 1991 Jul. 12; 253(5016):191-4). A tetraloop confers an increase in the melting temperature (Tm) of an adjacent duplex that is higher than expected from a simple model loop sequence consisting of four random bases. For example, a tetraloop can confer a melting temperature of at least 55° C. in 10 mM $NaHPO_4$ to a hairpin comprising a duplex of at least 2 base pairs in length. A tetraloop may contain ribonucleotides, deoxyribonucleotides, modified nucleotides, and combinations thereof. Examples of RNA tetraloops include the UNCG family of tetraloops (e.g., UUCG), the GNRA family of tetraloops (e.g., GAAA), and the CUUG tetraloop. (Woese et al., Proc Natl Acad Sci USA. 1990 November; 87(21):8467-71; Antao et al., Nucleic Acids Res. 1991 Nov. 11; 19(21):5901-5). Examples of DNA tetraloops include the d(GNNA) family of tetraloops (e.g., d(GTTA), the d(GNRA)) family of tetraloops, the d(GNAB) family of tetraloops, the d(CNNG) family of tetraloops, the d(TNCG) family of tetraloops (e.g., d(TTCG)). (Nakano et al. Biochemistry, 41 (48), 14281-14292, 2002.; SHINJI et al. Nippon Kagakkai Koen Yokoshu VOL. 78th; NO. 2; PAGE. 731 (2000).)

As used herein, the term "siRNA" refers to a double stranded nucleic acid in which each strand comprises RNA, RNA analog(s) or RNA and DNA. The siRNA comprises between 19 and 23 nucleotides or comprises 21 nucleotides. The siRNA typically has 2 bp overhangs on the 3' ends of each strand such that the duplex region in the siRNA comprises 17-21 nucleotides, or 19 nucleotides. Typically, the antisense strand of the siRNA is sufficiently complementary with the target sequence of the MET gene/RNA.

An anti-MET DsiRNA of the instant invention possesses strand lengths of at least 25 nucleotides. Accordingly, in certain embodiments, an anti-MET DsiRNA contains one oligonucleotide sequence, a first sequence, that is at least 25 nucleotides in length and no longer than 35 or up to 50 or more nucleotides. This sequence of RNA can be between 26 and 35, 26 and 34, 26 and 33, 26 and 32, 26 and 31, 26 and 30, and 26 and 29 nucleotides in length. This sequence can be 27 or 28 nucleotides in length or 27 nucleotides in length. The second sequence of the DsiRNA agent can be a sequence that anneals to the first sequence under biological conditions, such as within the cytoplasm of a eukaryotic cell. Generally, the second oligonucleotide sequence will have at least 19 complementary base pairs with the first oligonucleotide sequence, more typically the second oligonucleotide sequence will have 21 or more complementary base pairs, or 25 or more complementary base pairs with the first oligonucleotide sequence. In one embodiment, the second sequence is the same length as the first sequence, and the DsiRNA agent is blunt ended. In another embodiment, the ends of the DsiRNA agent have one or more overhangs.

In certain embodiments, the first and second oligonucleotide sequences of the DsiRNA agent exist on separate oligonucleotide strands that can be and typically are chemically synthesized. In some embodiments, both strands are between 26 and 35 nucleotides in length. In other embodiments, both strands are between 25 and 30 or 26 and 30 nucleotides in length. In one embodiment, both strands are 27 nucleotides in length, are completely complementary and have blunt ends. In certain embodiments of the instant invention, the first and second sequences of an anti-MET DsiRNA exist on separate RNA oligonucleotides (strands). In one embodiment, one or both oligonucleotide strands are capable of serving as a substrate for Dicer. In other embodiments, at least one modification is present that promotes Dicer to bind to the double-stranded RNA structure in an orientation that maximizes the double-stranded RNA structure's effectiveness in inhibiting gene expression. In certain embodiments of the instant invention, the anti-MET DsiRNA agent is comprised of two oligonucleotide strands of differing lengths, with the anti-MET DsiRNA possessing a blunt end at the 3' terminus of a first strand (sense strand) and a 3' overhang at the 3' terminus of a second strand (antisense strand). The DsiRNA can also contain one or more deoxyribonucleic acid (DNA) base substitutions.

Suitable DsiRNA compositions that contain two separate oligonucleotides can be chemically linked outside their annealing region by chemical linking groups. Many suitable chemical linking groups are known in the art and can be used. Suitable groups will not block Dicer activity on the DsiRNA and will not interfere with the directed destruction of the RNA transcribed from the target gene. Alternatively, the two separate oligonucleotides can be linked by a third oligonucleotide such that a hairpin structure is produced upon annealing of the two oligonucleotides making up the DsiRNA composition. The hairpin structure will not block Dicer activity on the DsiRNA and will not interfere with the directed destruction of the target RNA.

As used herein, a dsRNA, e.g., DsiRNA or siRNA, having a sequence "sufficiently complementary" to a target RNA or cDNA sequence (e.g., MET mRNA) means that the dsRNA has a sequence sufficient to trigger the destruction of the target RNA (where a cDNA sequence is recited, the RNA sequence corresponding to the recited cDNA sequence) by the RNAi machinery (e.g., the RISC complex) or process. For example, a dsRNA that is "sufficiently complementary" to a target RNA or cDNA sequence to trigger the destruction of the target RNA by the RNAi machinery or process can be identified as a dsRNA that causes a detectable reduction in the level of the target RNA in an appropriate assay of dsRNA activity (e.g., an in vitro assay as described in Example 2 below), or, in further examples, a dsRNA that is sufficiently complementary to a target RNA or cDNA sequence to trigger the destruction of the target RNA by the RNAi machinery or process can be identified as a dsRNA that produces at least a 5%, at least a 10%, at least a 15%, at least a 20%, at least a 25%, at least a 30%, at least a 35%, at least a 40%, at least a 45%, at least a 50%, at least a 55%, at least a 60%, at least a 65%, at least a 70%, at least a 75%, at least a 80%, at least a 85%, at least a 90%, at least a 95%, at least a 98% or at least a 99% reduction in the level of the target RNA in an appropriate assay of dsRNA activity. In additional examples, a dsRNA that is sufficiently complementary to a target RNA or cDNA sequence to trigger the destruction of the target RNA by the RNAi machinery or process can be identified based upon assessment of the duration of a certain level of inhibitory activity with respect to the target RNA or protein levels in a cell or organism. For example, a dsRNA that is sufficiently complementary to a target RNA or cDNA sequence to trigger the destruction of the target RNA by the RNAi machinery or process can be identified as a dsRNA capable of reducing target mRNA levels by at least 20% at least 48 hours post-administration of said dsRNA to a cell or organism. Preferably, a dsRNA that is sufficiently complementary to a target RNA or cDNA sequence to trigger the destruction of the target RNA by the RNAi machinery or process is identified as a dsRNA capable of reducing target mRNA levels by at least 40% at least 72 hours post-administration of said dsRNA to a cell or organism, by at least 40% at least four, five or seven days post-administration of said dsRNA to a cell or organism, by at least 50% at least 48 hours post-administration of said dsRNA to a cell or organism, by at least 50% at least 72 hours post-administration of said dsRNA to a cell or organism, by at least 50% at least four, five or seven days post-administration of said dsRNA to a cell or organism, by at least 80% at least 48 hours post-administration of said dsRNA to a cell or organism, by at least 80% at least 72 hours post-administration of said dsRNA to a cell or organism, or by at least 80% at least four, five or seven days post-administration of said dsRNA to a cell or organism.

The dsRNA molecule can be designed such that every residue of the antisense strand is complementary to a residue in the target molecule. Alternatively, substitutions can be made within the molecule to increase stability and/or enhance processing activity of said molecule. Substitutions can be made within the strand or can be made to residues at the ends of the strand. In certain embodiments, substitutions and/or modifications are made at specific residues within a DsiRNA agent. Such substitutions and/or modifications can include, e.g., deoxy-modifications at one or more residues of positions 1, 2 and 3 when numbering from the 3' terminal position of the sense strand of a DsiRNA agent; and introduction of 2'-O-alkyl (e.g., 2'-O-methyl) modifications at the 3' terminal residue of the antisense strand of DsiRNA agents, with such modifications also being performed at overhang positions of the 3' portion of the antisense strand and at alternating residues of the antisense strand of the DsiRNA that are included within the region of a DsiRNA agent that is processed to form an active siRNA agent. The preceding modifications are offered as exemplary, and are not intended to be limiting in any manner. Further consideration of the structure of preferred DsiRNA agents, including further description of the modifications and substitutions that can be performed upon the anti-MET DsiRNA agents of the instant invention, can be found below.

Where a first sequence is referred to as "substantially complementary" with respect to a second sequence herein, the two sequences can be fully complementary, or they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes of the invention.

The term "double-stranded RNA" or "dsRNA", as used herein, refers to a complex of ribonucleic acid molecules, having a duplex structure comprising two anti-parallel and substantially complementary, as defined above, nucleic acid strands. The two strands forming the duplex structure may be different portions of one larger RNA molecule, or they may be separate RNA molecules. Where separate RNA molecules, such dsRNA are often referred to as siRNA ("short interfering RNA") or DsiRNA ("Dicer substrate siRNAs"). Where the two strands are part of one larger molecule, and therefore are connected by an uninterrupted chain of nucleotides between the 3'-end of one strand and the 5' end of the respective other strand forming the duplex structure, the connecting RNA chain is referred to as a "hairpin loop", "short hairpin RNA" or "shRNA". Where the two strands are connected covalently by means other than an uninterrupted chain of nucleotides between the 3'-end of one strand and the 5' end of the respective other strand forming the duplex structure, the connecting structure is referred to as a "linker". The RNA strands may have the same or a different number of nucleotides. The maximum number of base pairs is the number of nucleotides in the shortest strand of the dsRNA minus any overhangs that are present in the duplex. In addition to the duplex structure, a dsRNA may comprise one or more nucleotide overhangs. In addition, as used herein, "dsRNA" may include chemical modifications to ribonucleotides, internucleoside linkages, end-groups, caps, and conjugated moieties, including substantial modifications at multiple nucleotides and including all types of modifications disclosed herein or known in the art. Any such modifications, as used in an siRNA- or DsiRNA-type molecule, are encompassed by "dsRNA" for the purposes of this specification and claims.

The phrase "duplex region" refers to the region in two complementary or substantially complementary oligonucleotides that form base pairs with one another, either by Watson-Crick base pairing or other manner that allows for a duplex between oligonucleotide strands that are complementary or substantially complementary. For example, an oligonucleotide strand having 21 nucleotide units can base pair with another oligonucleotide of 21 nucleotide units, yet only 19 bases on each strand are complementary or substantially complementary, such that the "duplex region" consists of 19 base pairs. The remaining base pairs may, for example, exist as 5' and 3' overhangs. Further, within the duplex region, 100% complementarity is not required; substantial complementarity is allowable within a duplex region. Substantial complementarity refers to complementarity between the strands such that they are capable of annealing under biological conditions. Techniques to empirically determine if two strands are capable of annealing under biological conditions are well know in the art. Alternatively, two strands can be synthesized and added together under biological conditions to determine if they anneal to one another.

Single-stranded nucleic acids that base pair over a number of bases are said to "hybridize." Hybridization is typically determined under physiological or biologically relevant conditions (e.g., intracellular: pH 7.2, 140 mM potassium ion; extracellular pH 7.4, 145 mM sodium ion). Hybridization conditions generally contain a monovalent cation and biologically acceptable buffer and may or may not contain a divalent cation, complex anions, e.g. gluconate from potassium gluconate, uncharged species such as sucrose, and inert polymers to reduce the activity of water in the sample, e.g. PEG. Such conditions include conditions under which base pairs can form.

Hybridization is measured by the temperature required to dissociate single stranded nucleic acids forming a duplex, i.e., (the melting temperature; Tm). Hybridization conditions are also conditions under which base pairs can form. Various conditions of stringency can be used to determine hybridization (see, e.g., Wahl, G. M. and S. L. Berger (1987) Methods Enzymol. 152:399; Kimmel, A. R. (1987) Methods Enzymol. 152:507). Stringent temperature conditions will ordinarily include temperatures of at least about 30° C., more preferably of at least about 37° C., and most preferably of at least about 42° C. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm(° C.)=2(# of A+T bases)+4(# of G+C bases). For hybrids between 18 and 49 base pairs in length, Tm(° C.)=81.5+16.6(log 10[Na+])+0.41 (% G+C)−(600/N), where N is the number of bases in the hybrid, and [Na+] is the concentration of sodium ions in the hybridization buffer ([Na+] for 1×SSC=0.165 M). For example, a hybridization determination buffer is shown in Table 1.

TABLE 1

| | final conc. | Vender | Cat# | Lot# | m.w./Stock | To make 50 mL solution |
|---|---|---|---|---|---|---|
| NaCl | 100 mM | Sigma | S-5150 | 41K8934 | 5M | 1 mL |
| KCl | 80 mM | Sigma | P-9541 | 70K0002 | 74.55 | 0.298 g |
| MgCl$_2$ | 8 mM | Sigma | M-1028 | 120K8933 | 1M | 0.4 mL |
| sucrose | 2% w/v | Fisher | BP220-212 | 907105 | 342.3 | 1 g |
| Tris-HCl | 16 mM | Fisher | BP1757-500 | 12419 | 1M | 0.8 mL |
| NaH$_2$PO$_4$ | 1 mM | Sigma | S-3193 | 52H-029515 | 120.0 | 0.006 g |
| EDTA | 0.02 mM | Sigma | E-7889 | 110K89271 | 0.5M | 2 µL |
| H$_2$O | | Sigma | W-4502 | 51K2359 adjust with HCl | | to 50 mL |
| pH = 7.0 at 20° C. | | | | | | |

Useful variations on hybridization conditions will be readily apparent to those skilled in the art. Hybridization techniques are well known to those skilled in the art and are described, for example, in Benton and Davis (Science 196: 180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Antisense to Molecular Cloning Techniques, 1987, Academic Press, New York); and Sambrook et al., Molecular Cloning: A Laboratory Manual, Cold Spring Harbor Laboratory Press, New York.

As used herein, "oligonucleotide strand" is a single stranded nucleic acid molecule. An oligonucleotide may comprise ribonucleotides, deoxyribonucleotides, modified nucleotides (e.g., nucleotides with 2' modifications, synthetic base analogs, etc.) or combinations thereof. Such modified oligonucleotides can be preferred over native forms because of properties such as, for example, enhanced cellular uptake and increased stability in the presence of nucleases.

As used herein, the term "ribonucleotide" encompasses natural and synthetic, unmodified and modified ribonucleotides. Modifications include changes to the sugar moiety, to the base moiety and/or to the linkages between ribonucleotides in the oligonucleotide. As used herein, the term "ribonucleotide" specifically excludes a deoxyribonucleotide, which is a nucleotide possessing a single proton group at the 2' ribose ring position.

As used herein, the term "deoxyribonucleotide" encompasses natural and synthetic, unmodified and modified deoxyribonucleotides. Modifications include changes to the sugar moiety, to the base moiety and/or to the linkages between deoxyribonucleotide in the oligonucleotide. As used herein, the term "deoxyribonucleotide" also includes a modified ribonucleotide that does not permit Dicer cleavage of a dsRNA agent, e.g., a 2'-O-methyl ribonucleotide, a phosphorothioate-modified ribonucleotide residue, etc., that does not permit Dicer cleavage to occur at a bond of such a residue.

As used herein, the term "PS-NA" refers to a phosphorothioate-modified nucleotide residue. The term "PS-NA" therefore encompasses both phosphorothioate-modified ribonucleotides ("PS-RNAs") and phosphorothioate-modified deoxyribonucleotides ("PS-DNAs").

As used herein, "Dicer" refers to an endoribonuclease in the RNase III family that cleaves a dsRNA or dsRNA-containing molecule, e.g., double-stranded RNA (dsRNA) or pre-microRNA (miRNA), into double-stranded nucleic acid fragments 19-25 nucleotides long, usually with a two-base overhang on the 3' end. With respect to certain dsRNAs of the invention (e.g., "DsiRNAs"), the duplex formed by a dsRNA region of an agent of the invention is recognized by Dicer and is a Dicer substrate on at least one strand of the duplex. Dicer catalyzes the first step in the RNA interference pathway, which consequently results in the degradation of a target RNA. The protein sequence of human Dicer is provided at the NCBI database under accession number NP_085124, hereby incorporated by reference.

Dicer "cleavage" can be determined as follows (e.g., see Collingwood et al., Oligonucleotides 18:187-200 (2008)). In a Dicer cleavage assay, RNA duplexes (100 pmol) are incubated in 20 µL of 20 mM Tris pH 8.0, 200 mM NaCl, 2.5 mM MgCl2 with or without 1 unit of recombinant human Dicer (Stratagene, La Jolla, Calif.) at 37° C. for 18-24 hours. Samples are desalted using a Performa SR 96-well plate (Edge Biosystems, Gaithersburg, Md.). Electrospray-ionization liquid chromatography mass spectroscopy (ESI-LCMS) of duplex RNAs pre- and post-treatment with Dicer is done using an Oligo HTCS system (Novatia, Princeton, N.J.; Hail et al., 2004), which consists of a ThermoFinnigan TSQ7000, Xcalibur data system, ProMass data processing software and Paradigm MS4 HPLC (Michrom BioResources, Auburn, Calif.). In this assay, Dicer cleavage occurs where at least 5%, 10%, 20%, 30%, 40%, 50%, 60%, 70%, 80%, 90%, 95%, or even 100% of the Dicer substrate dsRNA, (i.e., 25-30 bp, dsRNA, preferably 26-30 bp dsRNA) is cleaved to a shorter dsRNA (e.g., 19-23 bp dsRNA, preferably, 21-23 bp dsRNA).

As used herein, "Dicer cleavage site" refers to the sites at which Dicer cleaves a dsRNA (e.g., the dsRNA region of a DsiRNA agent of the invention). Dicer contains two RNase III domains which typically cleave both the sense and antisense strands of a dsRNA. The average distance between the RNase III domains and the PAZ domain determines the length of the short double-stranded nucleic acid fragments it produces and this distance can vary (Macrae et al. (2006) Science 311: 195-8). As shown in FIG. 1, Dicer is projected to cleave certain double-stranded ribonucleic acids of the instant invention that possess an antisense strand having a 2 nucleotide 3' overhang at a site between the $21^{st}$ and $22^{nd}$ nucleotides removed from the 3' terminus of the antisense strand, and at a corresponding site between the $21^{st}$ and $22^{nd}$ nucleotides removed from the 5' terminus of the sense strand. The projected and/or prevalent Dicer cleavage site(s) for dsRNA molecules distinct from those depicted in FIG. 1 may be similarly identified via art-recognized methods, including those described in Macrae et al. While the Dicer cleavage events depicted in FIG. 1 generate 21 nucleotide siRNAs, it is noted that Dicer cleavage of a dsRNA (e.g., DsiRNA) can result in generation of Dicer-processed siRNA lengths of 19 to 23 nucleotides in length. Indeed, in certain embodiments, a double-stranded DNA region may be included within a dsRNA for purpose of directing prevalent Dicer excision of a typically non-preferred 19mer or 20mer siRNA, rather than a 21mer.

As used herein, "overhang" refers to unpaired nucleotides, in the context of a duplex having one or more free ends at the 5' terminus or 3' terminus of a dsRNA. In certain embodiments, the overhang is a 3' or 5' overhang on the antisense strand or sense strand. In some embodiments, the overhang is a 3' overhang having a length of between one and six nucleotides, optionally one to five, one to four, one to three, one to two, two to six, two to five, two to four, two to three, three to six, three to five, three to four, four to six, four to five, five to six nucleotides, or one, two, three, four, five or six nucleotides. "Blunt" or "blunt end" means that there are no unpaired nucleotides at that end of the dsRNA, i.e., no nucleotide overhang. For clarity, chemical caps or non-nucleotide chemical moieties conjugated to the 3' end or 5' end of an siRNA are not considered in determining whether an siRNA has an overhang or is blunt ended. In certain embodiments, the invention provides a dsRNA molecule for inhibiting the expression of the MET target gene in a cell or mammal, wherein the dsRNA comprises an antisense strand comprising a region of complementarity which is complementary to at least a part of an mRNA formed in the expression of the MET target gene, and wherein the region of complementarity is less than 35 nucleotides in length, optionally 19-24 nucleotides in length or 25-30 nucleotides in length, and wherein the dsRNA, upon contact with a cell expressing the MET target gene, inhibits the expression of the MET target gene by at least 10%, 25%, or 40%.

A dsRNA of the invention comprises two RNA strands that are sufficiently complementary to hybridize to form a duplex structure. One strand of the dsRNA (the antisense strand) comprises a region of complementarity that is substantially complementary, and generally fully complementary, to a target sequence, derived from the sequence of an mRNA formed during the expression of the MET target gene, the other strand (the sense strand) comprises a region which is complementary to the antisense strand, such that the two strands hybridize and form a duplex structure when combined under suitable conditions. Generally, the duplex structure is between 15 and 35, optionally between 25 and 30, between 26 and 30, between 18 and 25, between 19 and 24, or between 19 and 21 base pairs in length. Similarly, the region of complementarity to the target sequence is between 15 and 35, optionally between 18 and 30, between 25 and 30, between 19 and 24, or between 19 and 21 nucleotides in length. The dsRNA of the invention may further comprise one or more single-stranded nucleotide overhang(s). It has been identified that dsRNAs comprising duplex structures of between 15 and 35 base pairs in length can be effective in inducing RNA interference, including DsiRNAs (generally of at least 25 base pairs in length) and siRNAs (in certain embodiments, duplex structures of siRNAs are between 20 and 23, and optionally, specifically 21 base pairs (Elbashir et al., *EMBO* 20: 6877-6888)). It has also been identified that dsRNAs possessing duplexes shorter than 20 base pairs can be effective as well (e.g., 15, 16, 17, 18 or 19 base pair duplexes). In certain embodiments, the dsRNAs of the invention can comprise at least one strand of a length of 19 nucleotides or more. In certain embodiments, it can be reasonably expected that shorter dsRNAs comprising a sequence complementary to one of the sequences of Table 6, minus only a few nucleotides on one or both ends may be similarly effective as compared to the dsRNAs described above and in Tables 2-5 and 7-10. Hence, dsRNAs comprising a partial sequence of at least 15, 16, 17, 18, 19, 20, or more contiguous nucleotides sufficiently complementary to one of the sequences of Table 6, and differing in their ability to inhibit the expression of the MET target gene in an assay as described herein by not more than 5, 10, 15, 20, 25, or 30% inhibition from a dsRNA comprising the full sequence, are contemplated by the invention. In one embodiment, at least one end of the dsRNA has a single-stranded nucleotide overhang of 1 to 5, optionally 1 to 4, in certain embodiments, 1 or 2 nucleotides. Certain dsRNA structures having at least one nucleotide overhang possess superior inhibitory properties as compared to counterparts possessing base-paired blunt ends at both ends of the dsRNA molecule.

As used herein, the term "RNA processing" refers to processing activities performed by components of the siRNA, miRNA or RNase H pathways (e.g., Drosha, Dicer, Argonaute2 or other RISC endoribonucleases, and RNaseH), which are described in greater detail below (see "RNA Processing" section below). The term is explicitly distinguished from the post-transcriptional processes of 5' capping of RNA and degradation of RNA via non-RISC- or non-RNase H-mediated processes. Such "degradation" of an RNA can take several forms, e.g. deadenylation (removal of a 3' poly(A) tail), and/or nuclease digestion of part or all of the body of the RNA by one or more of several endo- or exo-nucleases (e.g., RNase III, RNase P, RNase T1, RNase A (1, 2, 3, 4/5), oligonucleotidase, etc.).

By "homologous sequence" is meant, a nucleotide sequence that is shared by one or more polynucleotide sequences, such as genes, gene transcripts and/or non-coding polynucleotides. For example, a homologous sequence can be a nucleotide sequence that is shared by two or more genes encoding related but different proteins, such as different members of a gene family, different protein epitopes, different protein isoforms or completely divergent genes, such as a cytokine and its corresponding receptors. A homologous sequence can be a nucleotide sequence that is shared by two or more non-coding polynucleotides, such as noncoding DNA or RNA, regulatory sequences, introns, and sites of transcriptional control or regulation. Homologous sequences can also include conserved sequence regions shared by more than one polynucleotide sequence. Homology does not need to be perfect homology (e.g., 100%), as partially homologous sequences are also contemplated by the instant invention (e.g., 99%, 98%, 97%, 96%, 95%, 94%, 93%, 92%, 91%, 90%, 89%, 88%, 87%, 86%, 85%, 84%, 83%, 82%, 81%, 80% etc.). Indeed, design and use of the dsRNA agents of the instant invention contemplates the possibility of using such dsRNA agents not only against target RNAs of MET possessing perfect complementarity with the presently described dsRNA agents, but also against target MET RNAs possessing sequences that are, e.g., only 99%, 98%, 97%, 96%, 95%, 94%, 93%, 92%, 91%, 90%, 89%, 88%, 87%, 86%, 85%, 84%, 83%, 82%, 81%, 80% etc. complementary to said dsRNA agents. Similarly, it is contemplated that the presently described dsRNA agents of the instant invention might be readily altered by the skilled artisan to enhance the extent of complementarity between said dsRNA agents and a target MET RNA, e.g., of a specific allelic variant of MET (e.g., an allele of enhanced therapeutic interest). Indeed, dsRNA agent sequences with insertions, deletions, and single point mutations relative to the target MET sequence can also be effective for inhibition. Alternatively, dsRNA agent sequences with nucleotide analog substitutions or insertions can be effective for inhibition.

Sequence identity may be determined by sequence comparison and alignment algorithms known in the art. To determine the percent identity of two nucleic acid sequences (or of two amino acid sequences), the sequences are aligned for comparison purposes (e.g., gaps can be introduced in the first sequence or second sequence for optimal alignment). The nucleotides (or amino acid residues) at corresponding nucleotide (or amino acid) positions are then compared. When a position in the first sequence is occupied by the same residue as the corresponding position in the second sequence, then the molecules are identical at that position. The percent identity between the two sequences is a function of the number of identical positions shared by the sequences (i.e., % homology=# of identical positions/total # of positions×100), optionally penalizing the score for the number of gaps introduced and/or length of gaps introduced.

The comparison of sequences and determination of percent identity between two sequences can be accomplished using a mathematical algorithm. In one embodiment, the alignment generated over a certain portion of the sequence aligned having sufficient identity but not over portions having low degree of identity (i.e., a local alignment). A preferred, non-limiting example of a local alignment algorithm utilized for the comparison of sequences is the algorithm of Karlin and Altschul (1990) *Proc. Natl. Acad. Sci. USA* 87:2264-68, modified as in Karlin and Altschul (1993) *Proc. Natl. Acad. Sci. USA* 90:5873-77. Such an algorithm is incorporated into the BLAST programs (version 2.0) of Altschul, et al. (1990) *J. Mol. Biol.* 215:403-10.

In another embodiment, a gapped alignment the alignment is optimized is formed by introducing appropriate gaps, and percent identity is determined over the length of the aligned sequences (i.e., a gapped alignment). To obtain gapped alignments for comparison purposes, Gapped BLAST can be utilized as described in Altschul et al., (1997) Nucleic Acids Res. 25(17):3389-3402. In another embodiment, a global alignment the alignment is optimized is formed by introducing appropriate gaps, and percent identity is determined over the entire length of the sequences aligned. (i.e., a global alignment). A preferred, non-limiting example of a mathematical algorithm utilized for the global comparison of sequences is the algorithm of Myers and Miller, CABIOS (1989). Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used.

Greater than 80% sequence identity, e.g., 80%, 81%, 82%, 83%, 84%, 85%, 86%, 87%, 88%, 89%, 90%, 91%, 92%, 93%, 94%, 95%, 96%, 97%, 98%, 99% or even 100% sequence identity, between the dsRNA antisense strand and the portion of the MET RNA sequence is preferred. Alternatively, the dsRNA may be defined functionally as a nucleotide sequence (or oligonucleotide sequence) that is capable of hybridizing with a portion of the MET RNA (e.g., 400 mM NaCl, 40 mM PIPES pH 6.4, 1 mM EDTA, 50° C. or 70° C. hybridization for 12-16 hours; followed by washing). Additional preferred hybridization conditions include hybridization at 70° C. in 1×SSC or 50° C. in 1×SSC, 50% formamide followed by washing at 70° C. in 0.3×SSC or hybridization at 70° C. in 4×SSC or 50° C. in 4×SSC, 50% formamide followed by washing at 67° C. in 1×SSC. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm(° C.)=2(# of A+T bases)+4(# of G+C bases). For hybrids between 18 and 49 base pairs in length, Tm(° C.)=81.5+16.6 (log 10[Na+])+0.41 (% G+C)-(600/N), where N is the number of bases in the hybrid, and [Na+] is the concentration of sodium ions in the hybridization buffer ([Na+] for 1×SSC=0.165 M). Additional examples of stringency conditions for polynucleotide hybridization are provided in Sambrook, J., E. F. Fritsch, and T. Maniatis, 1989, Molecular Cloning: A Laboratory Manual, Cold Spring Harbor Laboratory Press, Cold Spring Harbor, N.Y., chapters 9 and 11, and Current Protocols in Molecular Biology, 1995, F. M. Ausubel et al., eds., John Wiley & Sons, Inc., sections 2.10 and 6.3-6.4. The length of the identical nucleotide sequences may be at least 10, 12, 15, 17, 20, 22, 25, 27 or 30 bases.

By "conserved sequence region" is meant, a nucleotide sequence of one or more regions in a polynucleotide does not vary significantly between generations or from one biological system, subject, or organism to another biological system, subject, or organism. The polynucleotide can include both coding and non-coding DNA and RNA.

By "sense region" is meant a nucleotide sequence of a dsRNA molecule having complementarity to an antisense region of the dsRNA molecule. In addition, the sense region of a dsRNA molecule can comprise a nucleic acid sequence having homology with a target nucleic acid sequence.

By "antisense region" is meant a nucleotide sequence of a dsRNA molecule having complementarity to a target nucleic acid sequence. In addition, the antisense region of a dsRNA molecule comprises a nucleic acid sequence having complementarity to a sense region of the dsRNA molecule.

As used herein, "antisense strand" refers to a single stranded nucleic acid molecule which has a sequence complementary to that of a target RNA. When the antisense strand contains modified nucleotides with base analogs, it is not necessarily complementary over its entire length, but must at least hybridize with a target RNA.

As used herein, "sense strand" refers to a single stranded nucleic acid molecule which has a sequence complementary to that of an antisense strand. When the antisense strand contains modified nucleotides with base analogs, the sense strand need not be complementary over the entire length of the antisense strand, but must at least duplex with the antisense strand.

As used herein, "guide strand" refers to a single stranded nucleic acid molecule of a dsRNA or dsRNA-containing molecule, which has a sequence sufficiently complementary to that of a target RNA to result in RNA interference. After cleavage of the dsRNA or dsRNA-containing molecule by Dicer, a fragment of the guide strand remains associated with RISC, binds a target RNA as a component of the RISC complex, and promotes cleavage of a target RNA by RISC. As used herein, the guide strand does not necessarily refer to a continuous single stranded nucleic acid and may comprise a discontinuity, preferably at a site that is cleaved by Dicer. A guide strand is an antisense strand.

As used herein, "passenger strand" refers to an oligonucleotide strand of a dsRNA or dsRNA-containing molecule, which has a sequence that is complementary to that of the guide strand. As used herein, the passenger strand does not necessarily refer to a continuous single stranded nucleic acid and may comprise a discontinuity, preferably at a site that is cleaved by Dicer. A passenger strand is a sense strand.

By "target nucleic acid" is meant a nucleic acid sequence whose expression, level or activity is to be modulated. The target nucleic acid can be DNA or RNA. For agents that target MET, in certain embodiments, the target nucleic acid is MET RNA. MET RNA target sites can also interchangeably be referenced by corresponding cDNA sequences. Levels of MET may also be targeted via targeting of upstream effectors of MET, or the effects of modulated or misregulated MET may also be modulated by targeting of molecules downstream of MET in the MET signalling pathway.

By "complementarity" is meant that a nucleic acid can form hydrogen bond(s) with another nucleic acid sequence by either traditional Watson-Crick or other non-traditional types. In reference to the nucleic molecules of the present invention, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, CSH Symp. Quant. Biol. LII pp. 123-133; Frier et al., 1986, Proc. Nat. Acad. Sci. USA 83:9373-9377; Turner et al., 1987, J. Am. Chem. Soc. 109:3783-3785). A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nucleotides out of a total of 10 nucleotides in the first oligonucleotide being based paired to a second nucleic acid sequence having 10 nucleotides represents 50%, 60%, 70%, 80%, 90%, and 100% complementary respectively). "Perfectly complementary" means that all the contiguous residues of a nucleic acid sequence will hydrogen bond with the same number of contiguous residues in a second nucleic acid sequence. In one embodiment, a dsRNA molecule of the invention comprises 19 to 30 (e.g., 19, 20, 21, 22, 23, 24, 25, 26, 27, 28, 29, or 30 or more) nucleotides that are complementary to one or more target nucleic acid molecules or a portion thereof.

In one embodiment, dsRNA molecules of the invention that down regulate or reduce MET gene expression are used for treating, preventing or reducing MET-related diseases or disorders (e.g., cancer) in a subject or organism.

In one embodiment of the present invention, each sequence of a DsiRNA molecule of the invention is independently 25 to 35 nucleotides in length, in specific embodiments 25, 26, 27, 28, 29, 30, 31, 32, 33, 34 or 35 nucleotides in length. In another embodiment, the DsiRNA duplexes of the invention independently comprise 25 to 30 base pairs (e.g., 25, 26, 27, 28, 29, or 30). In another embodiment, one or more strands of the DsiRNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (MET) nucleic acid molecule. In certain embodiments, a DsiRNA molecule of the invention possesses a length of duplexed nucleotides between 25 and 34 nucleotides in length (e.g., 25, 26, 27, 28, 29, 30, 31, 32, 33 or 34 nucleotides in length; optionally, all such nucleotides base pair with cognate nucleotides of the opposite strand). (Exemplary DsiRNA molecules of the invention are shown in FIG. 1, and below.

As used herein "cell" is used in its usual biological sense, and does not refer to an entire multicellular organism, e.g., specifically does not refer to a human. The cell can be present in an organism, e.g., birds, plants and mammals such as humans, cows, sheep, apes, monkeys, swine, dogs, and cats. The cell can be prokaryotic (e.g., bacterial cell) or eukaryotic (e.g., mammalian or plant cell). The cell can be of somatic or germ line origin, totipotent or pluripotent, dividing or non-dividing. The cell can also be derived from or can comprise a gamete or embryo, a stem cell, or a fully differentiated cell. Within certain aspects, the term "cell" refers specifically to mammalian cells, such as human cells, that contain one or more isolated dsRNA molecules of the present disclosure. In particular aspects, a cell processes dsRNAs or dsRNA-containing molecules resulting in RNA interference of target nucleic acids, and contains proteins and protein complexes required for RNAi, e.g., Dicer and RISC.

In certain embodiments, dsRNAs of the invention are Dicer substrate siRNAs ("DsiRNAs"). DsiRNAs can possess certain advantages as compared to inhibitory nucleic acids that are not dicer substrates ("non-DsiRNAs"). Such advantages include, but are not limited to, enhanced duration of effect of a DsiRNA relative to a non-DsiRNA, as well as enhanced inhibitory activity of a DsiRNA as compared to a non-DsiRNA (e.g., a 19-23mer siRNA) when each inhibitory nucleic acid is suitably formulated and assessed for inhibitory activity in a mammalian cell at the same concentration (in this latter scenario, the DsiRNA would be identified as more potent than the non-DsiRNA). Detection of the enhanced potency of a DsiRNA relative to a non-DsiRNA is often most readily achieved at a formulated concentration (e.g., transfection concentration of the dsRNA) that results in the DsiRNA eliciting approximately 30-70% knockdown activity upon a target RNA (e.g., a mRNA). For active DsiRNAs, such levels of knockdown activity are most often achieved at in vitro mammalian cell DsiRNA transfection concentrations of 1 nM or less of as suitably formulated, and in certain instances are observed at DsiRNA transfection concentrations of 200 pM or less, 100 pM or less, 50 pM or less, 20 pM or less, 10 pM or less, 5 pM or less, or even 1 pM or less. Indeed, due to the variability among DsiRNAs of the precise concentration at which 30-70% knockdown of a target RNA is observed, construction of an $IC_{50}$ curve via assessment of the inhibitory activity of DsiRNAs and non-DsiRNAs across a range of effective concentrations is a preferred method for detecting the enhanced potency of a DsiRNA relative to a non-DsiRNA inhibitory agent.

In certain embodiments, a DsiRNA (in a state as initially formed, prior to dicer cleavage) is more potent at reducing MET target gene expression in a mammalian cell than a 19, 20, 21, 22 or 23 base pair sequence that is contained within it. In certain such embodiments, a DsiRNA prior to dicer cleavage is more potent than a 19-21mer contained within it. Optionally, a DsiRNA prior to dicer cleavage is more potent than a 19 base pair duplex contained within it that is synthesized with symmetric dTdT overhangs (thereby forming a siRNA possessing 21 nucleotide strand lengths having dTdT overhangs). In certain embodiments, the DsiRNA is more potent than a 19-23mer siRNA (e.g., a 19 base pair duplex with dTdT overhangs) that targets at least 19 nucleotides of the 21 nucleotide target sequence that is recited for a DsiRNA of the invention (without wishing to be bound by theory, the identity of a such a target site for a DsiRNA is identified via identification of the Ago2 cleavage site for the DsiRNA; once the Ago2 cleavage site of a DsiRNA is determined for a DsiRNA, identification of the Ago2 cleavage site for any other inhibitory dsRNA can be performed and these Ago2 cleavage sites can be aligned, thereby determining the alignment of projected target nucleotide sequences for multiple dsRNAs). In certain related embodiments, the DsiRNA is more potent than a 19-23mer siRNA that targets at least 20 nucleotides of the 21 nucleotide target sequence that is recited for a DsiRNA of the invention. Optionally, the DsiRNA is more potent than a 19-23mer siRNA that targets the same 21 nucleotide target sequence that is recited for a DsiRNA of the invention. In certain embodiments, the DsiRNA is more potent than any 21mer siRNA that targets the same 21 nucleotide target sequence that is recited for a DsiRNA of the invention. Optionally, the DsiRNA is more potent than any 21 or 22mer siRNA that targets the same 21 nucleotide target sequence that is recited for a DsiRNA of the invention. In certain embodiments, the DsiRNA is more potent than any 21, 22 or 23mer siRNA that targets the same 21 nucleotide target sequence that is recited for a DsiRNA of the invention. As noted above, such potency assessments are most effectively performed upon dsRNAs that are suitably formulated (e.g., formulated with an appropriate transfection reagent) at a concentration of 1 nM or less. Optionally, an $IC_{50}$ assessment is performed to evaluate activity across a range of effective inhibitory concentrations, thereby allowing for robust comparison of the relative potencies of dsRNAs so assayed.

The dsRNA molecules of the invention are added directly, or can be complexed with lipids (e.g., cationic lipids), packaged within liposomes, or otherwise delivered to target cells or tissues. The nucleic acid or nucleic acid complexes can be locally administered to relevant tissues ex vivo, or in vivo through direct dermal application, transdermal application, or injection, with or without their incorporation in biopolymers. In particular embodiments, the nucleic acid molecules of the invention comprise sequences shown in FIG. 1, and the below exemplary structures. Examples of such nucleic acid molecules consist essentially of sequences defined in these figures and exemplary structures. Furthermore, where such agents are modified in accordance with the below description of modification patterning of DsiRNA agents, chemically modified forms of constructs described in FIG. 1, and the below exemplary structures can be used in all uses described for the DsiRNA agents of FIG. 1, and the below exemplary structures.

In another aspect, the invention provides mammalian cells containing one or more dsRNA molecules of this invention. The one or more dsRNA molecules can independently be targeted to the same or different sites.

By "RNA" is meant a molecule comprising at least one, and preferably at least 4, 8 and 12 ribonucleotide residues. The at least 4, 8 or 12 RNA residues may be contiguous. By "ribonucleotide" is meant a nucleotide with a hydroxyl group at the 2' position of a β-D-ribofuranose moiety. The terms include double-stranded RNA, single-stranded RNA, isolated RNA such as partially purified RNA, essentially pure RNA, synthetic RNA, recombinantly produced RNA, as well as altered RNA that differs from naturally occurring RNA by the addition, deletion, substitution and/or alteration of one or more nucleotides. Such alterations can include addition of non-nucleotide material, such as to the end(s) of the dsRNA or internally, for example at one or more nucleotides of the RNA. Nucleotides in the RNA molecules of the instant invention can also comprise non-standard nucleotides, such as non-naturally occurring nucleotides or chemically synthesized nucleotides or deoxynucleotides. These altered RNAs can be referred to as analogs or analogs of naturally-occurring RNA.

By "subject" is meant an organism, which is a donor or recipient of explanted cells or the cells themselves. "Subject" also refers to an organism to which the dsRNA agents of the invention can be administered. A subject can be a mammal or mammalian cells, including a human or human cells.

The phrase "pharmaceutically acceptable carrier" refers to a carrier for the administration of a therapeutic agent. Exemplary carriers include saline, buffered saline, dextrose, water, glycerol, ethanol, and combinations thereof. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract. The pharmaceutically acceptable carrier of the disclosed dsRNA compositions may be micellar structures, such as a liposomes, capsids, capsoids, polymeric nanocapsules, or polymeric microcapsules.

Polymeric nanocapsules or microcapsules facilitate transport and release of the encapsulated or bound dsRNA into the cell. They include polymeric and monomeric materials, especially including polybutylcyanoacrylate. A summary of materials and fabrication methods has been published (see Kreuter, 1991). The polymeric materials which are formed from monomeric and/or oligomeric precursors in the polymerization/nanoparticle generation step, are per se known from the prior art, as are the molecular weights and molecular weight distribution of the polymeric material which a person skilled in the field of manufacturing nanoparticles may suitably select in accordance with the usual skill.

Various methodologies of the instant invention include step that involves comparing a value, level, feature, characteristic, property, etc. to a "suitable control", referred to interchangeably herein as an "appropriate control". A "suitable control" or "appropriate control" is a control or standard familiar to one of ordinary skill in the art useful for comparison purposes. In one embodiment, a "suitable control" or "appropriate control" is a value, feature, characteristic, property, etc. determined prior to performing an RNAi methodology, as described herein. For example, a transcription rate, mRNA level, translation rate, protein level, biological activity, cellular characteristic or property, genotype, phenotype, etc. can be determined prior to introducing an RNA silencing agent (e.g., DsiRNA) of the invention into a cell or organism. In another embodiment, a "suitable control" or "appropriate control" is a value, level, feature, characteristic, property, etc. determined in a cell or organism, e.g., a control or normal cell or organism, exhibiting, for example, normal traits. In yet another embodiment, a "suitable control" or "appropriate control" is a predefined value, level, feature, characteristic, property, etc.

The term "in vitro" has its art recognized meaning, e.g., involving purified reagents or extracts, e.g., cell extracts. The term "in vivo" also has its art recognized meaning, e.g., involving living cells, e.g., immortalized cells, primary cells, cell lines, and/or cells in an organism.

"Treatment", or "treating" as used herein, is defined as the application or administration of a therapeutic agent (e.g., a dsRNA agent or a vector or transgene encoding same) to a patient, or application or administration of a therapeutic agent to an isolated tissue or cell line from a patient, who has a disorder with the purpose to cure, heal, alleviate, relieve, alter, remedy, ameliorate, improve or affect the disease or disorder, or symptoms of the disease or disorder. The term "treatment" or "treating" is also used herein in the context of administering agents prophylactically. The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. The term "patient" includes human and other mammalian subjects that receive either prophylactic or therapeutic treatment.

Structures of Anti-MET DsiRNA Agents

In certain embodiments, the anti-MET DsiRNA agents of the invention can have the following structures:

In one such embodiment, the DsiRNA comprises:

```
5'-XXXXXXXXXXXXXXXXXXXXXXXXX-3'

3'-YXXXXXXXXXXXXXXXXXXXXXXXX-5'
``` wherein "X"=RNA and "Y" is an overhang domain comprised of 1-4 RNA monomers that are optionally 2'-O-methyl RNA monomers. In a related embodiment, the DsiRNA comprises:

```
5'-XXXXXXXXXXXXXXXXXXXXXXXDD-3'

3'-YXXXXXXXXXXXXXXXXXXXXXXXX-5'
``` wherein "X"=RNA, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand.

DsiRNAs of the invention can carry a broad range of modification patterns (e.g., 2'-O-methyl RNA patterns, e.g., within extended DsiRNA agents). Certain modification patterns of the second strand of DsiRNAs of the invention are presented below.

In one embodiment, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers, and "D"=DNA. The top strand is the sense strand, and the bottom strand is the antisense strand.

In another such embodiment, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In another such embodiment, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In further embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M7" or "M7" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. The top strand is the sense strand, and the bottom strand is the antisense strand. In another related embodiment, the DsiRNA comprises:

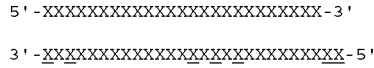

wherein "X"=RNA and "X"=2'-O-methyl RNA. The top strand is the sense strand, and the bottom strand is the antisense strand. In a further related embodiment, the DsiRNA comprises:

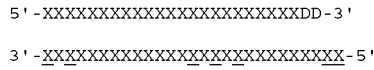

wherein "X"=RNA, "X"=2'-O-methyl RNA, and "D"=DNA. The top strand is the sense strand, and the bottom strand is the antisense strand. This modification pattern is also referred to herein as the "AS-M6" or "M6" modification pattern.

In other embodiments, the DsiRNA comprises:

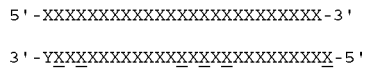

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

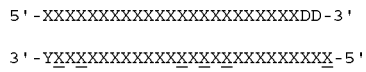

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

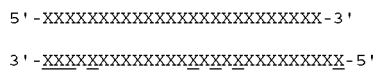

wherein "X"=RNA and "X"=2'-O-methyl RNA. The top strand is the sense strand, and the bottom strand is the antisense strand. In another related embodiment, the DsiRNA comprises:

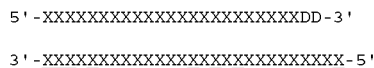

wherein "X"=RNA, "X"=2'-O-methyl RNA, and "D"=DNA. The top strand is the sense strand, and the bottom strand is the antisense strand. This modification pattern is also referred to herein as the "AS-M5" or "M5" modification pattern.

In further embodiments, the DsiRNA comprises:

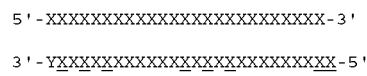

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

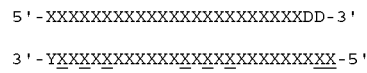

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

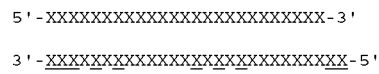

wherein "X"=RNA and "X"=2'-O-methyl RNA. The top strand is the sense strand, and the bottom strand is the antisense strand. In a further related embodiment, the DsiRNA comprises:

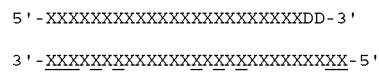

wherein "X"=RNA, "X"=2'-O-methyl RNA, and "D"=DNA. The top strand is the sense strand, and the bottom strand is the antisense strand. This modification pattern is also referred to herein as the "AS-M4" or "M4" modification pattern.

In additional embodiments, the DsiRNA comprises:

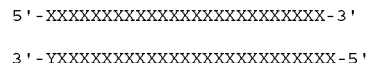

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

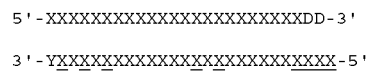

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

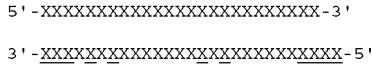

wherein "X"=RNA and "X"=2'-O-methyl RNA. The top strand is the sense strand, and the bottom strand is the antisense strand. In a further related embodiment, the DsiRNA comprises:

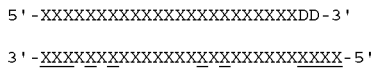

wherein "X"=RNA, "X"=2'-O-methyl RNA, and "D"=DNA. The top strand is the sense strand, and the bottom strand is the antisense strand. This modification pattern is also referred to herein as the "AS-M8" or "M8" modification pattern.

In other embodiments, the DsiRNA comprises:

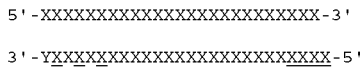

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

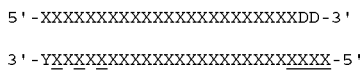

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

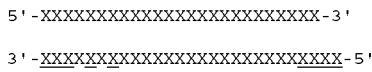

wherein "X"=RNA and "X"=2'-O-methyl RNA. The top strand is the sense strand, and the bottom strand is the antisense strand. In a further related embodiment, the DsiRNA comprises:

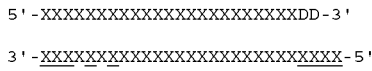

wherein "X"=RNA, "X"=2'-O-methyl RNA, and "D"=DNA. The top strand is the sense strand, and the bottom strand is the antisense strand. This modification pattern is also referred to herein as the "AS-M3" or "M3" modification pattern.

In additional embodiments, the DsiRNA comprises:

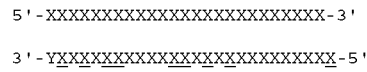

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

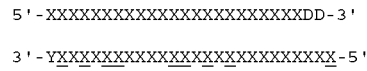

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

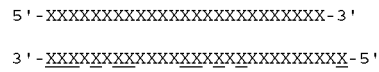

wherein "X"=RNA and "X"=2'-O-methyl RNA. The top strand is the sense strand, and the bottom strand is the antisense strand. In a further related embodiment, the DsiRNA comprises:

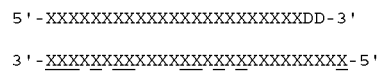

wherein "X"=RNA, "X"=2'-O-methyl RNA, and "D"=DNA. The top strand is the sense strand, and the bottom strand is the antisense strand. This modification pattern is also referred to herein as the "AS-M2" or "M2" modification pattern.

In further embodiments, the DsiRNA comprises:

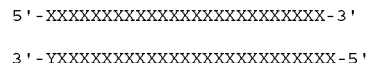

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

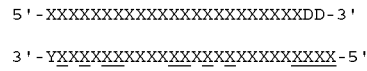

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M1" or "M1" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M9" or "M9" modification pattern.

In other embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M10" or "M10" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M11" or "M11" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M12" or "M12" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M13" or "M13" modification pattern.

In other embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In another related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

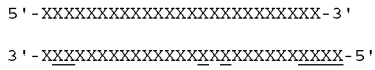

wherein "X"=RNA and "X"=2'-O-methyl RNA. The top strand is the sense strand, and the bottom strand is the antisense strand. In a further related embodiment, the DsiRNA comprises:

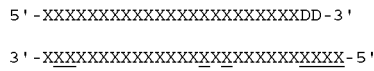

wherein "X"=RNA, "X"=2'-O-methyl RNA, and "D"=DNA. The top strand is the sense strand, and the bottom strand is the antisense strand. This modification pattern is also referred to herein as the "AS-M21" or "M21" modification pattern.

In further embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

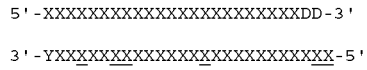

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

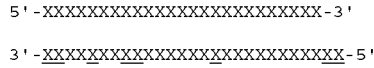

wherein "X"=RNA and "X"=2'-O-methyl RNA. The top strand is the sense strand, and the bottom strand is the antisense strand. In a further related embodiment, the DsiRNA comprises:

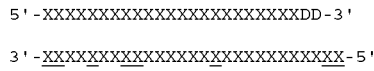

wherein "X"=RNA, "X"=2'-O-methyl RNA, and "D"=DNA. The top strand is the sense strand, and the bottom strand is the antisense strand. This modification pattern is also referred to herein as the "AS-M14" or "M14" modification pattern.

In additional embodiments, the DsiRNA comprises:

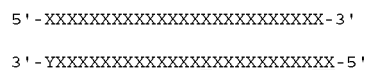

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

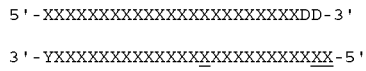

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

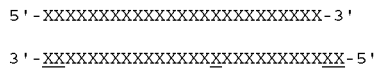

wherein "X"=RNA and "X"=2'-O-methyl RNA. The top strand is the sense strand, and the bottom strand is the antisense strand. In a further related embodiment, the DsiRNA comprises:

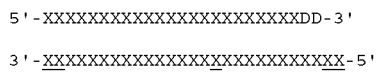

wherein "X"=RNA, "X"=2'-O-methyl RNA, and "D"=DNA. The top strand is the sense strand, and the bottom strand is the antisense strand. This modification pattern is also referred to herein as the "AS-M15" or "M15" modification pattern.

In further embodiments, the DsiRNA comprises:

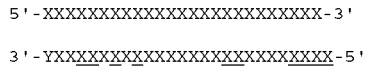

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

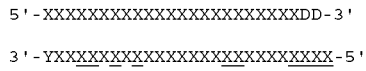

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M16" or "M16" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-β-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M17" or "M17" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M18" or "M18" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M19" or "M19" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M20" or "M20" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M22" or "M22" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "<u>X</u>"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "<u>X</u>"=2'-O-methyl RNA, and "D"=DNA. The top strand is the sense strand, and the bottom strand is the antisense strand. This modification pattern is also referred to herein as the "AS-M24" or "M24" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "<u>X</u>"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "<u>X</u>"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "<u>X</u>"=2'-O-methyl RNA, and "D"=DNA. The top strand is the sense strand, and the bottom strand is the antisense strand. This modification pattern is also referred to herein as the "AS-M25" or "M25" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "<u>X</u>"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "<u>X</u>"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "<u>X</u>"=2'-O-methyl RNA, and "D"=DNA. The top strand is the sense strand, and the bottom strand is the antisense strand. This modification pattern is also referred to herein as the "AS-M26" or "M26" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "<u>X</u>"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M27" or "M27" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M29" or "M29" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M30" or "M30" modification pattern.

```
5'-XXXXXXXXXXXXXXXXXXXXXXXDD-3'
3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M28" or "M28" modification pattern.

In further embodiments, the DsiRNA comprises:

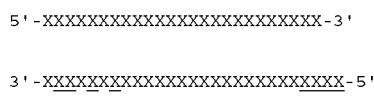

wherein "X"=RNA and "X"=2'-O-methyl RNA. The top strand is the sense strand, and the bottom strand is the antisense strand. In a further related embodiment, the DsiRNA comprises:

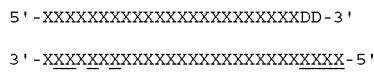

wherein "X"=RNA, "X"=2'-O-methyl RNA, and "D"=DNA. The top strand is the sense strand, and the bottom strand is the antisense strand. This modification pattern is also referred to herein as the "AS-M31" or "M31" modification pattern.

In additional embodiments, the DsiRNA comprises:

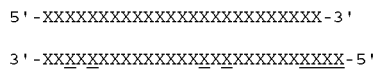

wherein "X"=RNA and "X"=2'-O-methyl RNA. The top strand is the sense strand, and the bottom strand is the antisense strand. In a further related embodiment, the DsiRNA comprises:

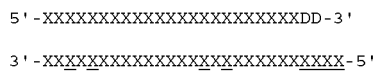

wherein "X"=RNA, "X"=2'-O-methyl RNA, and "D"=DNA. The top strand is the sense strand, and the bottom strand is the antisense strand. This modification pattern is also referred to herein as the "AS-M32" or "M32" modification pattern.

In further embodiments, the DsiRNA comprises:

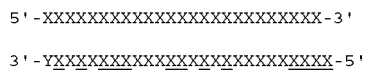

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

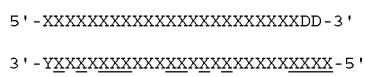

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

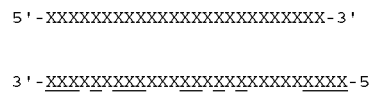

wherein "X"=RNA and "X"=2'-O-methyl RNA. The top strand is the sense strand, and the bottom strand is the antisense strand. In a further related embodiment, the DsiRNA comprises:

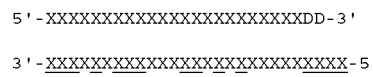

wherein "X"=RNA, "X"=2'-O-methyl RNA, and "D"=DNA. The top strand is the sense strand, and the bottom strand is the antisense strand. This modification pattern is also referred to herein as the "AS-M34" or "M34" modification pattern.

In additional embodiments, the DsiRNA comprises:

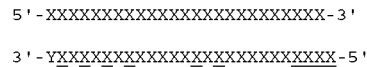

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

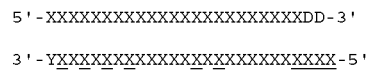

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

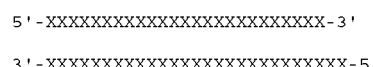

wherein "X"=RNA and "X"=2'-O-methyl RNA. The top strand is the sense strand, and the bottom strand is the antisense strand. In a further related embodiment, the DsiRNA comprises:

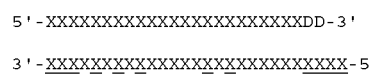

wherein "X"=RNA, "X"=2'-O-methyl RNA, and "D"=DNA. The top strand is the sense strand, and the bottom strand is the antisense strand. This modification pattern is also referred to herein as the "AS-M35" or "M35" modification pattern.

In further embodiments, the DsiRNA comprises:

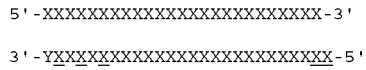

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

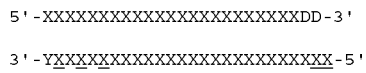

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

wherein "X"=RNA and "X̲"=2'-O-methyl RNA. The top strand is the sense strand, and the bottom strand is the antisense strand. In a further related embodiment, the DsiRNA comprises:

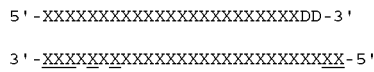

wherein "X"=RNA, "X̲"=2'-O-methyl RNA, and "D"=DNA. The top strand is the sense strand, and the bottom strand is the antisense strand. This modification pattern is also referred to herein as the "AS-M37" or "M37" modification pattern.

In additional embodiments, the DsiRNA comprises:

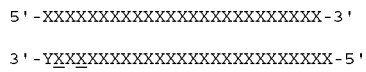

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

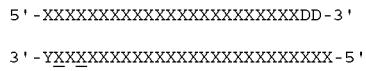

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

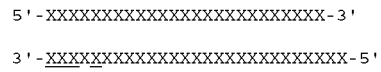

wherein "X"=RNA and "X̲"=2'-O-methyl RNA. The top strand is the sense strand, and the bottom strand is the antisense strand. In a further related embodiment, the DsiRNA comprises:

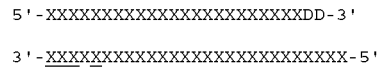

wherein "X"=RNA, "X̲"=2'-O-methyl RNA, and "D"=DNA. The top strand is the sense strand, and the bottom strand is the antisense strand. This modification pattern is also referred to herein as the "AS-M38" or "M38" modification pattern.

In further embodiments, the DsiRNA comprises:

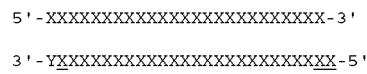

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

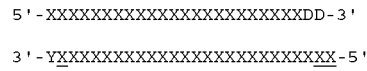

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

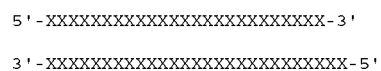

wherein "X"=RNA and "X̲"=2'-O-methyl RNA. The top strand is the sense strand, and the bottom strand is the antisense strand. In a further related embodiment, the DsiRNA comprises:

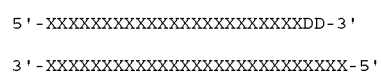

wherein "X"=RNA, "X̲"=2'-O-methyl RNA, and "D"=DNA. The top strand is the sense strand, and the bottom strand is the antisense strand. This modification pattern is also referred to herein as the "AS-M40" or "M40" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M41" or "M41" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M36" or "M36" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M42" or "M42" modification pattern.

In further embodiments, the DsiRNA comprises:

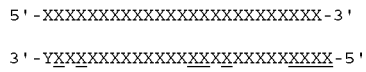

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

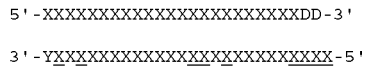

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

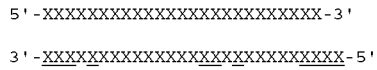

wherein "X"=RNA and "X"=2'-O-methyl RNA. The top strand is the sense strand, and the bottom strand is the antisense strand. In a further related embodiment, the DsiRNA comprises:

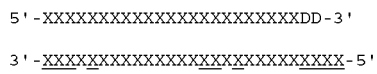

wherein "X"=RNA, "X"=2'-O-methyl RNA, and "D"=DNA. The top strand is the sense strand, and the bottom strand is the antisense strand. This modification pattern is also referred to herein as the "AS-M43" or "M43" modification pattern.

In additional embodiments, the DsiRNA comprises:

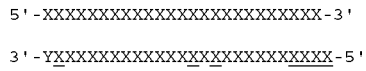

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

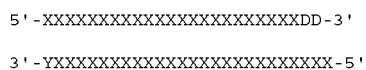

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

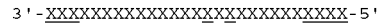

wherein "X"=RNA and "X"=2'-O-methyl RNA. The top strand is the sense strand, and the bottom strand is the antisense strand. In a further related embodiment, the DsiRNA comprises:

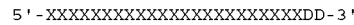
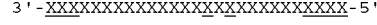

wherein "X"=RNA, "X"=2'-O-methyl RNA, and "D"=DNA. The top strand is the sense strand, and the bottom strand is the antisense strand. This modification pattern is also referred to herein as the "AS-M44" or "M44" modification pattern.

In further embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

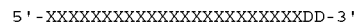
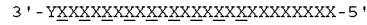

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

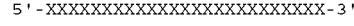

wherein "X"=RNA and "X"=2'-O-methyl RNA. The top strand is the sense strand, and the bottom strand is the antisense strand. In a further related embodiment, the DsiRNA comprises:

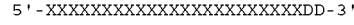

wherein "X"=RNA, "X"=2'-O-methyl RNA, and "D"=DNA. The top strand is the sense strand, and the bottom strand is the antisense strand. This modification pattern is also referred to herein as the "AS-M45" or "M45" modification pattern.

In additional embodiments, the DsiRNA comprises:

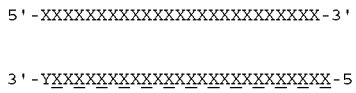

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

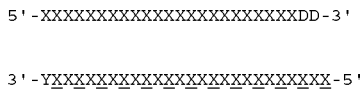

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

wherein "X"=RNA and "X"=2'-O-methyl RNA. The top strand is the sense strand, and the bottom strand is the antisense strand. In a further related embodiment, the DsiRNA comprises:

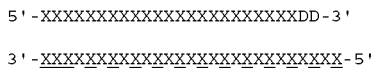

wherein "X"=RNA, "X"=2'-O-methyl RNA, and "D"=DNA. The top strand is the sense strand, and the bottom strand is the antisense strand. This modification pattern is also referred to herein as the "AS-M46" or "M46" modification pattern.

In additional embodiments, the DsiRNA comprises:

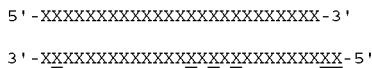

wherein "X"=RNA and "X"=2'-O-methyl RNA. In a further related embodiment, the DsiRNA comprises:

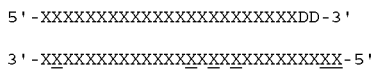

wherein "X"=RNA, "X"=2'-O-methyl RNA, and "D"=DNA. The top strand is the sense strand, and the bottom strand is the antisense strand. This modification pattern is also referred to herein as the "AS-M7*" or "M7*" modification pattern.

In further embodiments, the DsiRNA comprises:

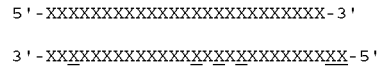

wherein "X"=RNA and "X"=2'-O-methyl RNA. The top strand is the sense strand, and the bottom strand is the antisense strand. In a further related embodiment, the DsiRNA comprises:

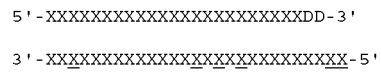

wherein "X"=RNA, "X"=2'-O-methyl RNA, and "D"=DNA. The top strand is the sense strand, and the bottom strand is the antisense strand. This modification pattern is also referred to herein as the "AS-M6*" or "M6*" modification pattern.

In other embodiments, the DsiRNA comprises:

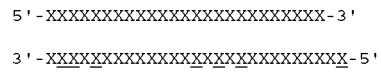

wherein "X"=RNA and "X"=2'-O-methyl RNA. The top strand is the sense strand, and the bottom strand is the antisense strand. In another related embodiment, the DsiRNA comprises:

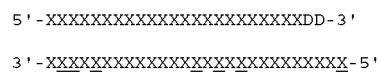

wherein "X"=RNA, "X"=2'-O-methyl RNA, and "D"=DNA. The top strand is the sense strand, and the bottom strand is the antisense strand. This modification pattern is also referred to herein as the "AS-M5*" or "M5*" modification pattern.

In further embodiments, the DsiRNA comprises:

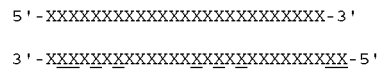

wherein "X"=RNA and "X"=2'-O-methyl RNA. The top strand is the sense strand, and the bottom strand is the antisense strand. In a further related embodiment, the DsiRNA comprises:

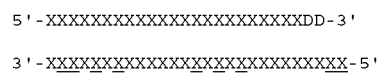

wherein "X"=RNA, "X"=2'-O-methyl RNA, and "D"=DNA. The top strand is the sense strand, and the bottom strand is the antisense strand. This modification pattern is also referred to herein as the "AS-M4*" or "M4*" modification pattern.

In additional embodiments, the DsiRNA comprises:

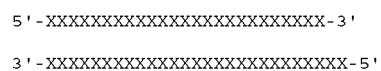

wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M8*" or "M8*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M2*" or "M2*" modification pattern.

In other embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M10*" or "M10*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M11*" or "M11*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M13*" or "M13*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M14*" or "M14*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M15*" or "M15*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M16*" or "M16*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M17*" or "M17*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M18*" or "M18*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M19*" or "M19*" modification pattern.

In further embodiments, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M20*" or "M20*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M22*" or "M22*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M24*" or "M24*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M25*" or "M25*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M26*" or "M26*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M27*" or "M27*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M28*" or "M28*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M29*" or "M29*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M34*" or "M34*" modification pattern.

In further embodiments, the DsiRNA comprises:

```
5'-XXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M35*" or "M35*" modification pattern.

In additional embodiments, the DsiRNA comprises:

```
5'-XXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M37*" or "M37*" modification pattern.

In further embodiments, the DsiRNA comprises:

```
5'-XXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M38*" or "M38*" modification pattern.

In further embodiments, the DsiRNA comprises:

```
5'-XXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M40*" or "M40*" modification pattern.

In additional embodiments, the DsiRNA comprises:

```
5'-XXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M41*" or "M41*" modification pattern.

In further embodiments, the DsiRNA comprises:

```
5'-XXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M36*" or "M36*" modification pattern.

In additional embodiments, the DsiRNA comprises:

wherein "X"=RNA and "X"=2'-O-methyl RNA. The top strand is the sense strand, and the bottom strand is the antisense strand. In a further related embodiment, the DsiRNA comprises:

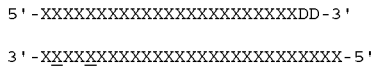

wherein "X"=RNA, "X"=2'-O-methyl RNA, and "D"=DNA. The top strand is the sense strand, and the bottom strand is the antisense strand. This modification pattern is also referred to herein as the "AS-M42*" or "M42*" modification pattern.

In further embodiments, the DsiRNA comprises:

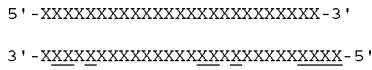

wherein "X"=RNA and "X"=2'-O-methyl RNA. The top strand is the sense strand, and the bottom strand is the antisense strand. In a further related embodiment, the DsiRNA comprises:

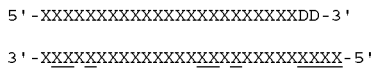

wherein "X"=RNA, "X"=2'-O-methyl RNA, and "D"=DNA. The top strand is the sense strand, and the bottom strand is the antisense strand. This modification pattern is also referred to herein as the "AS-M43*" or "M43*" modification pattern.

In additional embodiments, the DsiRNA comprises:

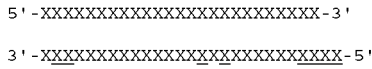

wherein "X"=RNA and "X"=2'-O-methyl RNA. The top strand is the sense strand, and the bottom strand is the antisense strand. In a further related embodiment, the DsiRNA comprises:

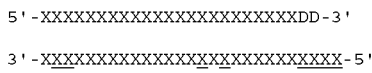

wherein "X"=RNA, "X"=2'-O-methyl RNA, and "D"=DNA. The top strand is the sense strand, and the bottom strand is the antisense strand. This modification pattern is also referred to herein as the "AS-M44*" or "M44*" modification pattern.

In further embodiments, the DsiRNA comprises:

wherein "X"=RNA and "X"=2'-O-methyl RNA. The top strand is the sense strand, and the bottom strand is the antisense strand. In a further related embodiment, the DsiRNA comprises:

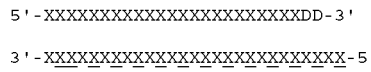

wherein "X"=RNA, "X"=2'-O-methyl RNA, and "D"=DNA. The top strand is the sense strand, and the bottom strand is the antisense strand. This modification pattern is also referred to herein as the "AS-M46*" or "M46*" modification pattern.

In certain embodiments, the sense strand of a DsiRNA of the invention is modified—specific exemplary forms of sense strand modifications are shown below, and it is contemplated that such modified sense strands can be substituted for the sense strand of any of the DsiRNAs shown above to generate a DsiRNA comprising a below-depicted sense strand that anneals with an above-depicted antisense strand. Exemplary sense strand modification patterns include:

```
5'-XXXXXXXXXXXXXXXXXXXXXXXXDD-3'    "SM1"
5'-XXXXXXXXXXXXXXXXXXXXXXXXDD-3'    "SM2"
5'-XXXXXXXXXXXXXXXXXXXXXXXXDD-3'    "SM3"
5'-XXXXXXXXXXXXXXXXXXXXXXXXDD-3'    "SM4"
5'-XXXXXXXXXXXXXXXXXXXXXXXXDD-3'    "SM5"
5'-XXXXXXXXXXXXXXXXXXXXXXXXDD-3'    "SM6"
5'-XXXXXXXXXXXXXXXXXXXXXXXXDD-3'    "SM7"
5'-XXXXXXXXXXXXXXXXXXXXXXXXDD-3'    "SM8"
5'-XXXXXXXXXXXXXXXXXXXXXXXXDD-3'    "SM9"
5'-XXXXXXXXXXXXXXXXXXXXXXXXDD-3'    "SM10"
5'-XXXXXXXXXXXXXXXXXXXXXXXXDD-3'    "SM11"
5'-XXXXXXXXXXXXXXXXXXXXXXXXDD-3'    "SM12"
5'-XXXXXXXXXXXXXXXXXXXXXXXXDD-3'    "SM13"
5'-XXXXXXXXXXXXXXXXXXXXXXXXDD-3'    "SM14"
5'-XXXXXXXXXXXXXXXXXXXXXXXXDD-3'    "SM15"
5'-XXXXXXXXXXXXXXXXXXXXXXXXDD-3'    "SM16"
5'-XXXXXXXXXXXXXXXXXXXXXXXXDD-3'    "SM17"
5'-XXXXXXXXXXXXXXXXXXXXXXXXDD-3'    "SM18"
5'-XXXXXXXXXXXXXXXXXXXXXXXXDD-3'    "SM19"
5'-XXXXXXXXXXXXXXXXXXXXXXXXDD-3'    "SM20"
5'-XXXXXXXXXXXXXXXXXXXXXXXXDD-3'    "SM21"
5'-XXXXXXXXXXXXXXXXXXXXXXXXXX-3'
```

-continued

```
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'  "SM22"
``` where "X"=RNA, "X"=2'-O-methyl RNA, and "D"=DNA.

The above modification patterns can also be incorporated into, e.g., the extended DsiRNA structures and mismatch and/or frayed DsiRNA structures described below.

In another embodiment, the DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary 27mer DsiRNA agent with two terminal mismatched residues is shown:

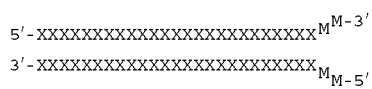

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand is the sense strand, and the bottom strand is the antisense strand. Alternatively, the bottom strand is the sense strand and the top strand is the antisense strand.

In certain additional embodiments, the present invention provides compositions for RNA interference (RNAi) that possess one or more base paired deoxyribonucleotides within a region of a double stranded ribonucleic acid (dsRNA) that is positioned 3' of a projected sense strand Dicer cleavage site and correspondingly 5' of a projected antisense strand Dicer cleavage site. The compositions of the invention comprise a dsRNA which is a precursor molecule, i.e., the dsRNA of the present invention is processed in vivo to produce an active small interfering nucleic acid (siRNA). The dsRNA is processed by Dicer to an active siRNA which is incorporated into RISC.

In certain embodiments, the DsiRNA agents of the invention can have the following exemplary structures (noting that any of the following exemplary structures can be combined, e.g., with the bottom strand modification patterns of the above-described structures—in one specific example, the bottom strand modification pattern shown in any of the above structures is applied to the 27 most 3' residues of the bottom strand of any of the following structures; in another specific example, the bottom strand modification pattern shown in any of the above structures upon the 23 most 3' residues of the bottom strand is applied to the 23 most 3' residues of the bottom strand of any of the following structures):

In one such embodiment, the DsiRNA comprises the following (an exemplary "right-extended", "DNA extended" DsiRNA):

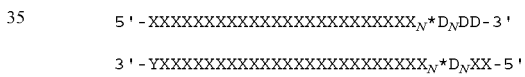

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

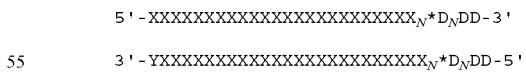

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

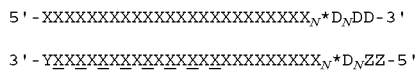

wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

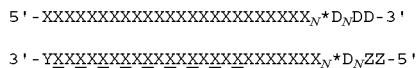

wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

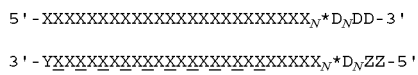

wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

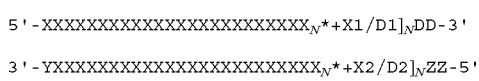

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In the structures depicted herein, the 5' end of either the sense strand or antisense strand can optionally comprise a phosphate group.

In another embodiment, a DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

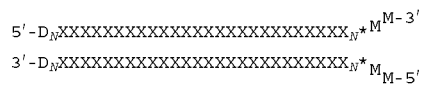

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-15 or, optionally, 1-8. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In one embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. An exemplary structure for such a molecule is shown:

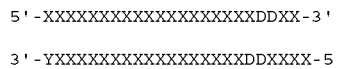

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand. The above structure is modeled to force Dicer to cleave a minimum of a 21mer duplex as its primary post-processing form. In embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O-methyl modification of at least the penultimate position from the 5' terminus of the antisense strand to reduce off-target effects; see, e.g., US 2007/0223427).

In one embodiment, the DsiRNA comprises the following (an exemplary "left-extended", "DNA extended" DsiRNA):

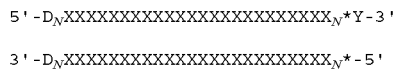

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

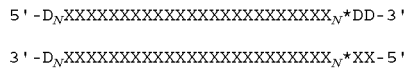

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

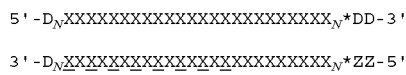

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

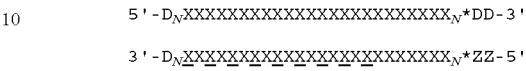

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

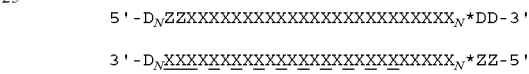

wherein "X"=RNA, "X"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

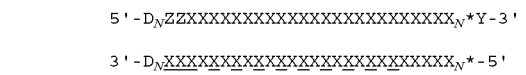

wherein "X"=RNA, "X"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

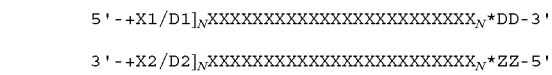

wherein "X"=RNA, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In a related embodiment, the DsiRNA comprises:

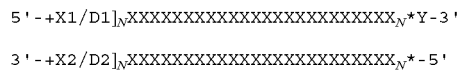

wherein "X"=RNA, "D"=DNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

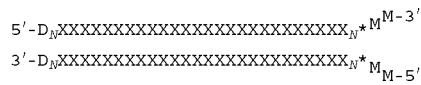

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-8 or 1-10. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In another embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. Exemplary structures for such a molecule are shown:

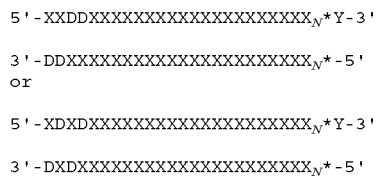

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In any of the above embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O-methyl modification of at least the penultimate position from the 5' terminus of the antisense strand to reduce off-target effects; see, e.g., US 2007/0223427).

In certain embodiments, the "D" residues of the above structures include at least one PS-DNA or PS-RNA. Optionally, the "D" residues of the above structures include at least one modified nucleotide that inhibits Dicer cleavage.

While the above-described "DNA-extended" DsiRNA agents can be categorized as either "left extended" or "right extended", DsiRNA agents comprising both left- and right-extended DNA-containing sequences within a single agent (e.g., both flanks surrounding a core dsRNA structure are dsDNA extensions) can also be generated and used in similar manner to those described herein for "right-extended" and "left-extended" agents.

In some embodiments, the DsiRNA of the instant invention further comprises a linking moiety or domain that joins the sense and antisense strands of a DNA:DNA-extended DsiRNA agent. Optionally, such a linking moiety domain joins the 3' end of the sense strand and the 5' end of the antisense strand. The linking moiety may be a chemical (non-nucleotide) linker, such as an oligomethylenediol linker, oligoethylene glycol linker, or other art-recognized linker moiety. Alternatively, the linker can be a nucleotide linker, optionally including an extended loop and/or tetraloop.

In one embodiment, the DsiRNA agent has an asymmetric structure, with the sense strand having a 25-base pair length, and the antisense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxynucleotides at the 3' end of the sense strand.

In another embodiment, the DsiRNA agent has an asymmetric structure, with the antisense strand having a 25-base pair length, and the sense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxyribonucleotides at the 3' end of the antisense strand.

Exemplary MET targeting DsiRNA agents of the invention, and their associated MET target sequences, include the following, presented in the below series of tables:

Table Number:
(2) Selected Human Anti-MET DsiRNA Agents (Asymmetrics);
(3) Selected Human Anti-MET DsiRNAs, Unmodified Duplexes (Asymmetrics);
(4) Selected Mouse Anti-MET DsiRNAs (Asymmetrics);
(5) Selected Mouse Anti-MET DsiRNAs, Unmodified Duplexes (Asymmetrics);
(6) DsiRNA Target Sequences (21mers) In MET;
(7) Selected Human Anti-MET "Blunt/Fray" DsiRNAs;
(8) Selected Mouse Anti-MET "Blunt/Fray" DsiRNAs;
(9) Selected Human Anti-MET "Blunt/Blunt" DsiRNAs; and
(10) Selected Mouse Anti-MET "Blunt/Blunt" DsiRNAs.

TABLE 2

Selected Human Anti-MET DsiRNA Agents (Asymmetrics)

```
                5'-CGCGGAGCGCGCGUGUGGUCCUUgc-3'        (SEQ ID NO: 1)
                3'-CCGCGCCUCGCGCGCACACCAGGAACG-5'      (SEQ ID NO: 361)
MET-136 Target: 5'-GGCGCGGAGCGCGCGTGTGGTCCTTGC-3'      (SEQ ID NO: 721)

5'-GCGGAGCGCGCGUGUGGUCCUUGcg-3'        (SEQ ID NO: 2)
                3'-CGCGCCUCGCGCGCACACCAGGAACGC-5'      (SEQ ID NO: 362)
MET-137 Target: 5'-GCGCGGAGCGCGCGTGTGGTCCTTGCG-3'      (SEQ ID NO: 722)

5'-CGGAGCGCGCGUGUGGUCCUUGCgc-3'        (SEQ ID NO: 3)
                3'-GCGCCUCGCGCGCACACCAGGAACGCG-5'      (SEQ ID NO: 363)
MET-138 Target: 5'-CGCGGAGCGCGCGTGTGGTCCTTGCGC-3'      (SEQ ID NO: 723)

5'-GAGCGCGCGUGUGGUCCUUGCGCcg-3'        (SEQ ID NO: 4)
                3'-GCCUCGCGCGCACACCAGGAACGCGGC-5'      (SEQ ID NO: 364)
MET-140 Target: 5'-CGGAGCGCGCGTGTGGTCCTTGCGCCG-3'      (SEQ ID NO: 724)

5'-GCGCGCGUGUGGUCCUUGCGCCGct-3'        (SEQ ID NO: 5)
                3'-CUCGCGCGCACACCAGGAACGCGGCGA-5'      (SEQ ID NO: 365)
MET-142 Target: 5'-GAGCGCGCGTGTGGTCCTTGCGCCGCT-3'      (SEQ ID NO: 725)

5'-CGCGCGUGUGGUCCUUGCGCCGCtg-3'        (SEQ ID NO: 6)
                3'-UCGCGCGCACACCAGGAACGCGGCGAC-5'      (SEQ ID NO: 366)
MET-143 Target: 5'-AGCGCGCGTGTGGTCCTTGCGCCGCTG-3'      (SEQ ID NO: 726)

5'-CGCGUGUGGUCCUUGCGCCGCUGac-3'        (SEQ ID NO: 7)
                3'-GCGCGCACACCAGGAACGCGGCGACUG-5'      (SEQ ID NO: 367)
MET-145 Target: 5'-CGCGCGTGTGGTCCTTGCGCCGCTGAC-3'      (SEQ ID NO: 727)

5'-GCGUGUGGUCCUUGCGCCGCUGAct-3'        (SEQ ID NO: 8)
                3'-CGCGCACACCAGGAACGCGGCGACUGA-5'      (SEQ ID NO: 368)
MET-146 Target: 5'-GCGCGTGTGGTCCTTGCGCCGCTGACT-3'      (SEQ ID NO: 728)

5'-GUGUGGUCCUUGCGCCGCUGACUtc-3'        (SEQ ID NO: 9)
                3'-CGCACACCAGGAACGCGGCGACUGAAG-5'      (SEQ ID NO: 369)
MET-148 Target: 5'-GCGTGTGGTCCTTGCGCCGCTGACTTC-3'      (SEQ ID NO: 729)

5'-CCUUGCGCCGCUGACUUCUCCACtg-3'        (SEQ ID NO: 10)
                3'-CAGGAACGCGGCGACUGAAGAGGUGAC-5'      (SEQ ID NO: 370)
MET-155 Target: 5'-GTCCTTGCGCCGCTGACTTCTCCACTG-3'      (SEQ ID NO: 730)

5'-GCGCCGCUGACUUCUCCACUGGUtc-3'        (SEQ ID NO: 11)
                3'-AACGCGGCGACUGAAGAGGUGACCAAG-5'      (SEQ ID NO: 371)
MET-159 Target: 5'-TTGCGCCGCTGACTTCTCCACTGGTTC-3'      (SEQ ID NO: 731)

5'-CUGUGCUUGCACCUGGCAUCCUCgt-3'        (SEQ ID NO: 12)
                3'-GCGACACGAACGUGGACCGUAGGAGCA-5'      (SEQ ID NO: 372)
MET-225 Target: 5'-CGCTGTGCTTGCACCTGGCATCCTCGT-3'      (SEQ ID NO: 732)

5'-GUGCUUGCACCUGGCAUCCUCGUgc-3'        (SEQ ID NO: 13)
                3'-GACACGAACGUGGACCGUAGGAGCACG-5'      (SEQ ID NO: 373)
MET-227 Target: 5'-CTGTGCTTGCACCTGGCATCCTCGTGC-3'      (SEQ ID NO: 733)

5'-CACCUGGCAUCCUCGUGCUCCUGtt-3'        (SEQ ID NO: 14)
                3'-ACGUGGACCGUAGGAGCACGAGGACAA-5'      (SEQ ID NO: 374)
MET-234 Target: 5'-TGCACCTGGCATCCTCGTGCTCCTGTT-3'      (SEQ ID NO: 734)

5'-CUCGUGCUCCUGUUUACCUUGGUgc-3'        (SEQ ID NO: 15)
                3'-AGGAGCACGAGGACAAAUGGAACCACG-5'      (SEQ ID NO: 375)
MET-245 Target: 5'-TCCTCGTGCTCCTGTTTACCTTGGTGC-3'      (SEQ ID NO: 735)
```

TABLE 2-continued

| | Selected Human Anti-MET DsiRNA Agents (Asymmetrics) | |
|---|---|---|
| MET-248 Target: | 5'-GUGCUCCUGUUUACCUUGGUGCAga-3'<br>3'-AGCACGAGGACAAAUGGAACCACGUCU-5'<br>5'-TCGTGCTCCTGTTTACCTTGGTGCAGA-3' | (SEQ ID NO: 16)<br>(SEQ ID NO: 376)<br>(SEQ ID NO: 736) |
| MET-249 Target: | 5'-UGCUCCUGUUUACCUUGGUGCAGag-3'<br>3'-GCACGAGGACAAAUGGAACCACGUCUC-5'<br>5'-CGTGCTCCTGTTTACCTTGGTGCAGAG-3' | (SEQ ID NO: 17)<br>(SEQ ID NO: 377)<br>(SEQ ID NO: 737) |
| MET-409 Target: | 5'-CACUAACUACAUUUAUGUUUUAAat-3'<br>3'-CGGUGAUUGAUGUAAAUACAAAAUUUA-5'<br>5'-GCCACTAACTACATTTATGTTTTAAAT-3' | (SEQ ID NO: 18)<br>(SEQ ID NO: 378)<br>(SEQ ID NO: 738) |
| MET-413 Target: | 5'-AACUACAUUUAUGUUUUAAAUGAgg-3'<br>3'-GAUUGAUGUAAAUACAAAAUUUACUCC-5'<br>5'-CTAACTACATTTATGTTTTAAATGAGG-3' | (SEQ ID NO: 19)<br>(SEQ ID NO: 379)<br>(SEQ ID NO: 739) |
| MET-414 Target: | 5'-ACUACAUUUAUGUUUUAAAUGAGga-3'<br>3'-AUUGAUGUAAAUACAAAAUUUACUCCU-5'<br>5'-TAACTACATTTATGTTTTAAATGAGGA-3' | (SEQ ID NO: 20)<br>(SEQ ID NO: 380)<br>(SEQ ID NO: 740) |
| MET-415 Target: | 5'-CUACAUUUAUGUUUUAAAUGAGGaa-3'<br>3'-UUGAUGUAAAUACAAAAUUUACUCCUU-5'<br>5'-AACTACATTTATGTTTTAAATGAGGAA-3' | (SEQ ID NO: 21)<br>(SEQ ID NO: 381)<br>(SEQ ID NO: 741) |
| MET-416 Target: | 5'-UACAUUUAUGUUUUAAAUGAGGAag-3'<br>3'-UGAUGUAAAUACAAAAUUUACUCCUUC-5'<br>5'-ACTACATTTATGTTTTAAATGAGGAAG-3' | (SEQ ID NO: 22)<br>(SEQ ID NO: 382)<br>(SEQ ID NO: 742) |
| MET-417 Target: | 5'-ACAUUUAUGUUUUAAAUGAGGAAga-3'<br>3'-GAUGUAAAUACAAAAUUUACUCCUUCU-5'<br>5'-CTACATTTATGTTTTAAATGAGGAAGA-3' | (SEQ ID NO: 23)<br>(SEQ ID NO: 383)<br>(SEQ ID NO: 743) |
| MET-480 Target: | 5'-UGGAACACCCAGAUUGUUUCCCAtg-3'<br>3'-CGACCUUGUGGGUCUAACAAAGGGUAC-5'<br>5'-GCTGGAACACCCAGATTGTTTCCCATG-3' | (SEQ ID NO: 24)<br>(SEQ ID NO: 384)<br>(SEQ ID NO: 744) |
| MET-508 Target: | 5'-GGACUGCAGCAGCAAAGCCAAUUta-3'<br>3'-GUCCUGACGUCGUCGUUUCGGUUAAAU-5'<br>5'-CAGGACTGCAGCAGCAAAGCCAATTTA-3' | (SEQ ID NO: 25)<br>(SEQ ID NO: 385)<br>(SEQ ID NO: 745) |
| MET-509 Target: | 5'-GACUGCAGCAGCAAAGCCAAUUUat-3'<br>3'-UCCUGACGUCGUCGUUUCGGUUAAAUA-5'<br>5'-AGGACTGCAGCAGCAAAGCCAATTTAT-3' | (SEQ ID NO: 26)<br>(SEQ ID NO: 386)<br>(SEQ ID NO: 746) |
| MET-510 Target: | 5'-ACUGCAGCAGCAAAGCCAAUUUAtc-3'<br>3'-CCUGACGUCGUCGUUUCGGUUAAAUAG-5'<br>5'-GGACTGCAGCAGCAAAGCCAATTTATC-3' | (SEQ ID NO: 27)<br>(SEQ ID NO: 387)<br>(SEQ ID NO: 747) |
| MET-511 Target: | 5'-CUGCAGCAGCAAAGCCAAUUUAUca-3'<br>3'-CUGACGUCGUCGUUUCGGUUAAAUAGU-5'<br>5'-GACTGCAGCAGCAAAGCCAATTTATCA-3' | (SEQ ID NO: 28)<br>(SEQ ID NO: 388)<br>(SEQ ID NO: 748) |
| MET-512 Target: | 5'-UGCAGCAGCAAAGCCAAUUUAUCag-3'<br>3'-UGACGUCGUCGUUUCGGUUAAAUAGUC-5'<br>5'-ACTGCAGCAGCAAAGCCAATTTATCAG-3' | (SEQ ID NO: 29)<br>(SEQ ID NO: 389)<br>(SEQ ID NO: 749) |
| MET-584 Target: | 5'-UACUAUGAUGAUCAACUCAUUAGct-3'<br>3'-GGAUGAUACUACUAGUUGAGUAAUCGA-5'<br>5'-CCTACTATGATGATCAACTCATTAGCT-3' | (SEQ ID NO: 30)<br>(SEQ ID NO: 390)<br>(SEQ ID NO: 750) |
| MET-585 Target: | 5'-ACUAUGAUGAUCAACUCAUUAGCtg-3'<br>3'-GAUGAUACUACUAGUUGAGUAAUCGAC-5'<br>5'-CTACTATGATGATCAACTCATTAGCTG-3' | (SEQ ID NO: 31)<br>(SEQ ID NO: 391)<br>(SEQ ID NO: 751) |
| MET-586 Target: | 5'-CUAUGAUGAUCAACUCAUUAGCUgt-3'<br>3'-AUGAUACUACUAGUUGAGUAAUCGACA-5'<br>5'-TACTATGATGATCAACTCATTAGCTGT-3' | (SEQ ID NO: 32)<br>(SEQ ID NO: 392)<br>(SEQ ID NO: 752) |
| MET-587 Target: | 5'-UAUGAUGAUCAACUCAUUAGCUGtg-3'<br>3'-UGAUACUACUAGUUGAGUAAUCGACAC-5'<br>5'-ACTATGATGATCAACTCATTAGCTGTG-3' | (SEQ ID NO: 33)<br>(SEQ ID NO: 393)<br>(SEQ ID NO: 753) |
| MET-588 Target: | 5'-AUGAUGAUCAACUCAUUAGCUGUgg-3'<br>3'-GAUACUACUAGUUGAGUAAUCGACACC-5'<br>5'-CTATGATGATCAACTCATTAGCTGTGG-3' | (SEQ ID NO: 34)<br>(SEQ ID NO: 394)<br>(SEQ ID NO: 754) |

TABLE 2-continued

Selected Human Anti-MET DsiRNA Agents (Asymmetrics)

```
                5'-UGAUGAUCAACUCAUUAGCUGUGgc-3'      (SEQ ID NO: 35)
                3'-AUACUACUAGUUGAGUAAUCGACACCG-5'    (SEQ ID NO: 395)
MET-589 Target: 5'-TATGATGATCAACTCATTAGCTGTGGC-3'    (SEQ ID NO: 755)

5'-GAUGAUCAACUCAUUAGCUGUGGCa-3'      (SEQ ID NO: 36)
                3'-UACUACUAGUUGAGUAAUCGACACCGU-5'    (SEQ ID NO: 396)
MET-590 Target: 5'-ATGATGATCAACTCATTAGCTGTGGCA-3'    (SEQ ID NO: 756)

5'-AUGAUCAACUCAUUAGCUGUGGCag-3'      (SEQ ID NO: 37)
                3'-ACUACUAGUUGAGUAAUCGACACCGUC-5'    (SEQ ID NO: 397)
MET-591 Target: 5'-TGATGATCAACTCATTAGCTGTGGCAG-3'    (SEQ ID NO: 757)

5'-UGAUCAACUCAUUAGCUGUGGCAgc-3'      (SEQ ID NO: 38)
                3'-CUACUAGUUGAGUAAUCGACACCGUCG-5'    (SEQ ID NO: 398)
MET-592 Target: 5'-GATGATCAACTCATTAGCTGTGGCAGC-3'    (SEQ ID NO: 758)

5'-GAUCAACUCAUUAGCUGUGGCAGcg-3'      (SEQ ID NO: 39)
                3'-UACUAGUUGAGUAAUCGACACCGUCGC-5'    (SEQ ID NO: 399)
MET-593 Target: 5'-ATGATCAACTCATTAGCTGTGGCAGCG-3'    (SEQ ID NO: 759)

5'-AUCAACUCAUUAGCUGUGGCAGCgt-3'      (SEQ ID NO: 40)
                3'-ACUAGUUGAGUAAUCGACACCGUCGCA-5'    (SEQ ID NO: 400)
MET-594 Target: 5'-TGATCAACTCATTAGCTGTGGCAGCGT-3'    (SEQ ID NO: 760)

5'-UCAACUCAUUAGCUGUGGCAGCGtc-3'      (SEQ ID NO: 41)
                3'-CUAGUUGAGUAAUCGACACCGUCGCAG-5'    (SEQ ID NO: 401)
MET-595 Target: 5'-GATCAACTCATTAGCTGTGGCAGCGTC-3'    (SEQ ID NO: 761)

5'-CAACUCAUUAGCUGUGGCAGCGUca-3'      (SEQ ID NO: 42)
                3'-UAGUUGAGUAAUCGACACCGUCGCAGU-5'    (SEQ ID NO: 402)
MET-596 Target: 5'-ATCAACTCATTAGCTGTGGCAGCGTCA-3'    (SEQ ID NO: 762)

5'-AACUCAUUAGCUGUGGCAGCGUCaa-3'      (SEQ ID NO: 43)
                3'-AGUUGAGUAAUCGACACCGUCGCAGUU-5'    (SEQ ID NO: 403)
MET-597 Target: 5'-TCAACTCATTAGCTGTGGCAGCGTCAA-3'    (SEQ ID NO: 763)

5'-GAUGGUUUUAUGUUUUUGACGGAcc-3'      (SEQ ID NO: 44)
                3'-UUCUACCAAAAUACAAAAACUGCCUGG-5'    (SEQ ID NO: 404)
MET-881 Target: 5'-AAGATGGTTTTATGTTTTTGACGGACC-3'    (SEQ ID NO: 764)

5'-CUUUGAAAGCAACAAUUUUAUUUac-3'      (SEQ ID NO: 45)
                3'-CGGAAACUUUCGUUGUUAAAAUAAAUG-5'    (SEQ ID NO: 405)
MET-967 Target: 5'-GCCTTTGAAAGCAACAATTTTATTTAC-3'    (SEQ ID NO: 765)

5'-GGAAACUCUAGAUGCUCAGACUUtt-3'      (SEQ ID NO: 46)
                3'-UCCCUUUGAGAUCUACGAGUCUGAAAA-5'    (SEQ ID NO: 406)
MET-1009 Target: 5'-AGGGAAACTCTAGATGCTCAGACTTTT-3'   (SEQ ID NO: 766)

5'-GAAACUCUAGAUGCUCAGACUUUtc-3'      (SEQ ID NO: 47)
                3'-CCCUUUGAGAUCUACGAGUCUGAAAAG-5'    (SEQ ID NO: 407)
MET-1010 Target: 5'-GGGAAACTCTAGATGCTCAGACTTTTC-3'   (SEQ ID NO: 767)

5'-AAACUCUAGAUGCUCAGACUUUUca-3'      (SEQ ID NO: 48)
                3'-CCUUUGAGAUCUACGAGUCUGAAAAGU-5'    (SEQ ID NO: 408)
MET-1011 Target: 5'-GGAAACTCTAGATGCTCAGACTTTTCA-3'   (SEQ ID NO: 768)

5'-AACUCUAGAUGCUCAGACUUUUCac-3'      (SEQ ID NO: 49)
                3'-CUUUGAGAUCUACGAGUCUGAAAAGUG-5'    (SEQ ID NO: 409)
MET-1012 Target: 5'-GAAACTCTAGATGCTCAGACTTTTCAC-3'   (SEQ ID NO: 769)

5'-ACUCUAGAUGCUCAGACUUUUCAca-3'      (SEQ ID NO: 50)
                3'-UUUGAGAUCUACGAGUCUGAAAAGUGU-5'    (SEQ ID NO: 410)
MET-1013 Target: 5'-AAACTCTAGATGCTCAGACTTTTCACA-3'   (SEQ ID NO: 770)

5'-CUCUAGAUGCUCAGACUUUUCACac-3'      (SEQ ID NO: 51)
                3'-UUGAGAUCUACGAGUCUGAAAAGUGUG-5'    (SEQ ID NO: 411)
MET-1014 Target: 5'-AACTCTAGATGCTCAGACTTTTCACAC-3'   (SEQ ID NO: 771)

5'-CACAAGAAUAAUCAGGUUCUGUUcc-3'      (SEQ ID NO: 52)
                3'-GUGUGUUCUUAUUAGUCCAAGACAAGG-5'    (SEQ ID NO: 412)
MET-1036 Target: 5'-CACACAAGAATAATCAGGTTCTGTTCC-3'   (SEQ ID NO: 772)

5'-CAAGAAUAAUCAGGUUCUGUUCCat-3'      (SEQ ID NO: 53)
                3'-GUGUUCUUAUUAGUCCAAGACAAGGUA-5'    (SEQ ID NO: 413)
MET-1038 Target: 5'-CACAAGAATAATCAGGTTCTGTTCCAT-3'   (SEQ ID NO: 773)
```

TABLE 2-continued

Selected Human Anti-MET DsiRNA Agents (Asymmetrics)

```
              5'-AAGAAUAAUCAGGUUCUGUUCCAta-3'     (SEQ ID NO: 54)
              3'-UGUUCUUAUUAGUCCAAGACAAGGUAU-5'   (SEQ ID NO: 414)
MET-1039 Target: 5'-ACAAGAATAATCAGGTTCTGTTCCATA-3' (SEQ ID NO: 774)

5'-AGAAUAAUCAGGUUCUGUUCCAUaa-3'    (SEQ ID NO: 55)
              3'-GUUCUUAUUAGUCCAAGACAAGGUAUU-5'  (SEQ ID NO: 415)
MET-1040 Target: 5'-CAAGAATAATCAGGTTCTGTTCCATAA-3' (SEQ ID NO: 775)

5'-GAAUAAUCAGGUUCUGUUCCAUAaa-3'    (SEQ ID NO: 56)
              3'-UUCUUAUUAGUCCAAGACAAGGUAUUU-5'  (SEQ ID NO: 416)
MET-1041 Target: 5'-AAGAATAATCAGGTTCTGTTCCATAAA-3' (SEQ ID NO: 776)

5'-AAUAAUCAGGUUCUGUUCCAUAAac-3'    (SEQ ID NO: 57)
              3'-UCUUAUUAGUCCAAGACAAGGUAUUUG-5'  (SEQ ID NO: 417)
MET-1042 Target: 5'-AGAATAATCAGGTTCTGTTCCATAAAC-3' (SEQ ID NO: 777)

5'-GUUCCAUAAACUCUGGAUUGCAUtc-3'    (SEQ ID NO: 58)
              3'-GACAAGGUAUUUGAGACCUAACGUAAG-5'  (SEQ ID NO: 418)
MET-1056 Target: 5'-CTGTTCCATAAACTCTGGATTGCATTC-3' (SEQ ID NO: 778)

5'-GGAGUGUAUUCUCACAGAAAAGAga-3'    (SEQ ID NO: 59)
              3'-GACCUCACAUAAGAGUGUCUUUUCUCU-5'  (SEQ ID NO: 419)
MET-1099 Target: 5'-CTGGAGTGTATTCTCACAGAAAAGAGA-3' (SEQ ID NO: 779)

5'-GGAAGUGUUUAAUAUACUUCAGGct-3'    (SEQ ID NO: 60)
              3'-UUCCUUCACAAAUUAUAUGAAGUCCGA-5'  (SEQ ID NO: 420)
MET-1144 Target: 5'-AAGGAAGTGTTTAATATACTTCAGGCT-3' (SEQ ID NO: 780)

5'-CAGGCUGCGUAUGUCAGCAAGCCtg-3'    (SEQ ID NO: 61)
              3'-AAGUCCGACGCAUACAGUCGUUCGGAC-5'  (SEQ ID NO: 421)
MET-1163 Target: 5'-TTCAGGCTGCGTATGTCAGCAAGCCTG-3' (SEQ ID NO: 781)

5'-GCACAAAGCAAGCCAGAUUCUGCCg-3'    (SEQ ID NO: 62)
              3'-AGCGUGUUUCGUUCGGUCUAAGACGGC-5'  (SEQ ID NO: 422)
MET-1250 Target: 5'-TCGCACAAAGCAAGCCAGATTCTGCCG-3' (SEQ ID NO: 782)

5'-CACAAAGCAAGCCAGAUUCUGCCga-3'    (SEQ ID NO: 63)
              3'-GCGUGUUUCGUUCGGUCUAAGACGGCU-5'  (SEQ ID NO: 423)
MET-1251 Target: 5'-CGCACAAAGCAAGCCAGATTCTGCCGA-3' (SEQ ID NO: 783)

5'-ACAAAGCAAGCCAGAUUCUGCCGaa-3'    (SEQ ID NO: 64)
              3'-CGUGUUUCGUUCGGUCUAAGACGGCUU-5'  (SEQ ID NO: 424)
MET-1252 Target: 5'-GCACAAAGCAAGCCAGATTCTGCCGAA-3' (SEQ ID NO: 784)

5'-CAAAGCAAGCCAGAUUCUGCCGAac-3'    (SEQ ID NO: 65)
              3'-GUGUUUCGUUCGGUCUAAGACGGCUUG-5'  (SEQ ID NO: 425)
MET-1253 Target: 5'-CACAAAGCAAGCCAGATTCTGCCGAAC-3' (SEQ ID NO: 785)

5'-AAAGCAAGCCAGAUUCUGCCGAAcc-3'    (SEQ ID NO: 66)
              3'-UGUUUCGUUCGGUCUAAGACGGCUUGG-5'  (SEQ ID NO: 426)
MET-1254 Target: 5'-ACAAAGCAAGCCAGATTCTGCCGAACC-3' (SEQ ID NO: 786)

5'-GUGAGAUGUCUCCAGCAUUUUUAcg-3'    (SEQ ID NO: 67)
              3'-UACACUCUACAGAGGUCGUAAAAAUGC-5'  (SEQ ID NO: 427)
MET-1358 Target: 5'-ATGTGAGATGTCTCCAGCATTTTTACG-3' (SEQ ID NO: 787)

5'-UGAGAUGUCUCCAGCAUUUUUACgg-3'    (SEQ ID NO: 68)
              3'-ACACUCUACAGAGGUCGUAAAAAUGCC-5'  (SEQ ID NO: 428)
MET-1359 Target: 5'-TGTGAGATGTCTCCAGCATTTTTACGG-3' (SEQ ID NO: 788)

5'-GAGAUGUCUCCAGCAUUUUUACGga-3'    (SEQ ID NO: 69)
              3'-CACUCUACAGAGGUCGUAAAAAUGCCU-5'  (SEQ ID NO: 429)
MET-1360 Target: 5'-GTGAGATGTCTCCAGCATTTTTACGGA-3' (SEQ ID NO: 789)

5'-AGAUGUCUCCAGCAUUUUUACGGac-3'    (SEQ ID NO: 70)
              3'-ACUCUACAGAGGUCGUAAAAAUGCCUG-5'  (SEQ ID NO: 430)
MET-1361 Target: 5'-TGAGATGTCTCCAGCATTTTTACGGAC-3' (SEQ ID NO: 790)

5'-GAUGUCUCCAGCAUUUUUACGGAcc-3'    (SEQ ID NO: 71)
              3'-CUCUACAGAGGUCGUAAAAAUGCCUGG-5'  (SEQ ID NO: 431)
MET-1362 Target: 5'-GAGATGTCTCCAGCATTTTTACGGACC-3' (SEQ ID NO: 791)

5'-AUGUCUCCAGCAUUUUUACGGACcc-3'    (SEQ ID NO: 72)
              3'-UCUACAGAGGUCGUAAAAAUGCCUGGG-5'  (SEQ ID NO: 432)
MET-1363 Target: 5'-AGATGTCTCCAGCATTTTTACGGACCC-3' (SEQ ID NO: 792)
```

TABLE 2-continued

Selected Human Anti-MET DsiRNA Agents (Asymmetrics)

```
              5'-UGUCUCCAGCAUUUUUACGGACCCca-3'      (SEQ ID NO: 73)
              3'-CUACAGAGGUCGUAAAAAUGCCUGGGU-5'     (SEQ ID NO: 433)
MET-1364 Target: 5'-GATGTCTCCAGCATTTTTACGGACCCA-3'  (SEQ ID NO: 793)

5'-GUCUCCAGCAUUUUUACGGACCCaa-3'       (SEQ ID NO: 74)
              3'-UACAGAGGUCGUAAAAAUGCCUGGGUU-5'     (SEQ ID NO: 434)
MET-1365 Target: 5'-ATGTCTCCAGCATTTTTACGGACCCAA-3'  (SEQ ID NO: 794)

5'-UCUCCAGCAUUUUUACGGACCCAat-3'       (SEQ ID NO: 75)
              3'-ACAGAGGUCGUAAAAAUGCCUGGGUUA-5'     (SEQ ID NO: 435)
MET-1366 Target: 5'-TGTCTCCAGCATTTTTACGGACCCAAT-3'  (SEQ ID NO: 795)

5'-CUCCAGCAUUUUUACGGACCCAAtc-3'       (SEQ ID NO: 76)
              3'-CAGAGGUCGUAAAAAUGCCUGGGUUAG-5'     (SEQ ID NO: 436)
MET-1367 Target: 5'-GTCTCCAGCATTTTTACGGACCCAATC-3'  (SEQ ID NO: 796)

5'-UCCAGCAUUUUUACGGACCCAAUca-3'       (SEQ ID NO: 77)
              3'-AGAGGUCGUAAAAAUGCCUGGGUUAGU-5'     (SEQ ID NO: 437)
MET-1368 Target: 5'-TCTCCAGCATTTTTACGGACCCAATCA-3'  (SEQ ID NO: 797)

5'-CCAGCAUUUUUACGGACCCAAUCat-3'       (SEQ ID NO: 78)
              3'-GAGGUCGUAAAAAUGCCUGGGUUAGUA-5'     (SEQ ID NO: 438)
MET-1369 Target: 5'-CTCCAGCATTTTTACGGACCCAATCAT-3'  (SEQ ID NO: 798)

5'-CAGCAUUUUUACGGACCCAAUCAtg-3'       (SEQ ID NO: 79)
              3'-AGGUCGUAAAAAUGCCUGGGUUAGUAC-5'     (SEQ ID NO: 439)
MET-1370 Target: 5'-TCCAGCATTTTTACGGACCCAATCATG-3'  (SEQ ID NO: 799)

5'-AGCAUUUUUACGGACCCAAUCAUga-3'       (SEQ ID NO: 80)
              3'-GGUCGUAAAAAUGCCUGGGUUAGUACU-5'     (SEQ ID NO: 440)
MET-1371 Target: 5'-CCAGCATTTTTACGGACCCAATCATGA-3'  (SEQ ID NO: 800)

5'-UUUACCACAGCUUUGCAGCGCGUtg-3'       (SEQ ID NO: 81)
              3'-UCAAAUGGUGUCGAAACGUCGCGCAAC-5'     (SEQ ID NO: 441)
MET-1469 Target: 5'-AGTTTACCACAGCTTTGCAGCGCGTTG-3'  (SEQ ID NO: 801)

5'-UACCACAGCUUUGCAGCGCGUUGac-3'       (SEQ ID NO: 82)
              3'-AAAUGGUGUCGAAACGUCGCGCAACUG-5'     (SEQ ID NO: 442)
MET-1471 Target: 5'-TTTACCACAGCTTTGCAGCGCGTTGAC-3'  (SEQ ID NO: 802)

5'-CCACAGCUUUGCAGCGCGUUGACtt-3'       (SEQ ID NO: 83)
              3'-AUGGUGUCGAAACGUCGCGCAACUGAA-5'     (SEQ ID NO: 443)
MET-1473 Target: 5'-TACCACAGCTTTGCAGCGCGTTGACTT-3'  (SEQ ID NO: 803)

5'-CACAGCUUUGCAGCGCGUUGACUta-3'       (SEQ ID NO: 84)
              3'-UGGUGUCGAAACGUCGCGCAACUGAAU-5'     (SEQ ID NO: 444)
MET-1474 Target: 5'-ACCACAGCTTTGCAGCGCGTTGACTTA-3'  (SEQ ID NO: 804)

5'-CAGCUUUGCAGCGCGUUGACUUAtt-3'       (SEQ ID NO: 85)
              3'-GUGUCGAAACGUCGCGCAACUGAAUAA-5'     (SEQ ID NO: 445)
MET-1476 Target: 5'-CACAGCTTTGCAGCGCGTTGACTTATT-3'  (SEQ ID NO: 805)

5'-GCUUUGCAGCGCGUUGACUUAUUca-3'       (SEQ ID NO: 86)
              3'-GUCGAAACGUCGCGCAACUGAAUAAGU-5'     (SEQ ID NO: 446)
MET-1478 Target: 5'-CAGCTTTGCAGCGCGTTGACTTATTCA-3'  (SEQ ID NO: 806)

5'-CUUUGCAGCGCGUUGACUUAUUCat-3'       (SEQ ID NO: 87)
              3'-UCGAAACGUCGCGCAACUGAAUAAGUA-5'     (SEQ ID NO: 447)
MET-1479 Target: 5'-AGCTTTGCAGCGCGTTGACTTATTCAT-3'  (SEQ ID NO: 807)

5'-UUUGCAGCGCGUUGACUUAUUCAtg-3'       (SEQ ID NO: 88)
              3'-CGAAACGUCGCGCAACUGAAUAAGUAC-5'     (SEQ ID NO: 448)
MET-1480 Target: 5'-GCTTTGCAGCGCGTTGACTTATTCATG-3'  (SEQ ID NO: 808)

5'-UUGCAGCGCGUUGACUUAUUCAUgg-3'       (SEQ ID NO: 89)
              3'-GAAACGUCGCGCAACUGAAUAAGUACC-5'     (SEQ ID NO: 449)
MET-1481 Target: 5'-CTTTGCAGCGCGTTGACTTATTCATGG-3'  (SEQ ID NO: 809)

5'-UGACCAUAUGUGGCUGGGACUUUgg-3'       (SEQ ID NO: 90)
              3'-CGACUGGUAUACACCGACCCUGAAACC-5'     (SEQ ID NO: 450)
MET-1953 Target: 5'-GCTGACCATATGTGGCTGGGACTTTGG-3'  (SEQ ID NO: 810)

5'-GACCAUAUGUGGCUGGGACUUUGga-3'       (SEQ ID NO: 91)
              3'-GACUGGUAUACACCGACCCUGAAACCU-5'     (SEQ ID NO: 451)
MET-1954 Target: 5'-CTGACCATATGTGGCTGGGACTTTGGA-3'  (SEQ ID NO: 811)
```

TABLE 2-continued

Selected Human Anti-MET DsiRNA Agents (Asymmetrics)

```
                5'-ACCAUAUGUGGCUGGGACUUUGGat-3'   (SEQ ID NO: 92)
                3'-ACUGGUAUACACCGACCCUGAAACCUA-5' (SEQ ID NO: 452)
MET-1955 Target: 5'-TGACCATATGTGGCTGGGACTTTGGAT-3' (SEQ ID NO: 812)

5'-CCAUAUGUGGCUGGGACUUUGGAtt-3'   (SEQ ID NO: 93)
                3'-CUGGUAUACACCGACCCUGAAACCUAA-5' (SEQ ID NO: 453)
MET-1956 Target: 5'-GACCATATGTGGCTGGGACTTTGGATT-3' (SEQ ID NO: 813)

5'-CAUAUGUGGCUGGGACUUUGGAUtt-3'   (SEQ ID NO: 94)
                3'-UGGUAUACACCGACCCUGAAACCUAAA-5' (SEQ ID NO: 454)
MET-1957 Target: 5'-ACCATATGTGGCTGGGACTTTGGATTT-3' (SEQ ID NO: 814)

5'-AUAUGUGGCUGGGACUUUGGAUUtc-3'   (SEQ ID NO: 95)
                3'-GGUAUACACCGACCCUGAAACCUAAAG-5' (SEQ ID NO: 455)
MET-1958 Target: 5'-CCATATGTGGCTGGGACTTTGGATTTC-3' (SEQ ID NO: 815)

5'-UAUGUGGCUGGGACUUUGGAUUUcg-3'   (SEQ ID NO: 96)
                3'-GUAUACACCGACCCUGAAACCUAAAGC-5' (SEQ ID NO: 456)
MET-1959 Target: 5'-CATATGTGGCTGGGACTTTGGATTTCG-3' (SEQ ID NO: 816)

5'-AUGUGGCUGGGACUUUGGAUUUCgg-3'   (SEQ ID NO: 97)
                3'-UAUACACCGACCCUGAAACCUAAAGCC-5' (SEQ ID NO: 457)
MET-1960 Target: 5'-ATATGTGGCTGGGACTTTGGATTTCGG-3' (SEQ ID NO: 817)

5'-UGUGGCUGGGACUUUGGAUUUCGga-3'   (SEQ ID NO: 98)
                3'-AUACACCGACCCUGAAACCUAAAGCCU-5' (SEQ ID NO: 458)
MET-1961 Target: 5'-TATGTGGCTGGGACTTTGGATTTCGGA-3' (SEQ ID NO: 818)

5'-GUGGCUGGGACUUUGGAUUUCGGag-3'   (SEQ ID NO: 99)
                3'-UACACCGACCCUGAAACCUAAAGCCUC-5' (SEQ ID NO: 459)
MET-1962 Target: 5'-ATGTGGCTGGGACTTTGGATTTCGGAG-3' (SEQ ID NO: 819)

5'-CGGAGGAAUAAUAAAUUUGAUUUaa-3'   (SEQ ID NO: 100)
                3'-AAGCCUCCUUAUUAUUUAAACUAAAUU-5' (SEQ ID NO: 460)
MET-1982 Target: 5'-TTCGGAGGAATAATAAATTTGATTTAA-3' (SEQ ID NO: 820)

5'-GAAUAAUAAAUUUGAUUUAAAGAaa-3'   (SEQ ID NO: 101)
                3'-UCCUUAUUAUUUAAACUAAAUUUCUUU-5' (SEQ ID NO: 461)
MET-1987 Target: 5'-AGGAATAATAAATTTGATTTAAAGAAA-3' (SEQ ID NO: 821)

5'-AAUAAUAAAUUUGAUUUAAAGAAaa-3'   (SEQ ID NO: 102)
                3'-CCUUAUUAUUUAAACUAAAUUUCUUUU-5' (SEQ ID NO: 462)
MET-1988 Target: 5'-GGAATAATAAATTTGATTTAAAGAAAA-3' (SEQ ID NO: 822)

5'-UUGAAAUGCACAGUUGGUCCUGCca-3'   (SEQ ID NO: 103)
                3'-GUACUUUACGUGUCAACCAGGACGGU-5'  (SEQ ID NO: 463)
MET-2075 Target: 5'-CATTGAAATGCACAGTTGGTCCTGCCA-3' (SEQ ID NO: 823)

5'-UGAAAUGCACAGUUGGUCCUGCCat-3'   (SEQ ID NO: 104)
                3'-UAACUUUACGUGUCAACCAGGACGGUA-5' (SEQ ID NO: 464)
MET-2076 Target: 5'-ATTGAAATGCACAGTTGGTCCTGCCAT-3' (SEQ ID NO: 824)

5'-CAAUAUGUCCAUAAUUAUUUCAAat-3'   (SEQ ID NO: 105)
                3'-AAGUUAUACAGGUAUUAAUAAAGUUUA-5' (SEQ ID NO: 465)
MET-2113 Target: 5'-TTCAATATGTCCATAATTATTTCAAAT-3' (SEQ ID NO: 825)

5'-UGGAAAAACAUGUACUUUAAAAGt-3'    (SEQ ID NO: 106)
                3'-CCACCUUUUUGUACAUGAAAUUUUUCA-5' (SEQ ID NO: 466)
MET-2290 Target: 5'-GGTGGAAAAACATGTACTTTAAAAGT-3'  (SEQ ID NO: 826)

5'-UACCACUCCUUCCCUGCAACAGCtg-3'  (SEQ ID NO: 107)
                3'-ACAUGGUGAGGAAGGGACGUUGUCGAC-5' (SEQ ID NO: 467)
MET-2668 Target: 5'-TGTACCACTCCTTCCCTGCAACAGCTG-3' (SEQ ID NO: 827)

5'-AGCCUUUUGAAAAGCCAGUGAUGat-3'   (SEQ ID NO: 108)
                3'-AUUCGGAAAACUUUUCGGUCACUACUA-5' (SEQ ID NO: 468)
MET-2790 Target: 5'-TAAGCCTTTTGAAAAGCCAGTGATGAT-3' (SEQ ID NO: 828)

5'-AUAUUGACCCUGAAGCAGUUAAAgg-3'   (SEQ ID NO: 109)
                3'-ACUAUAACUGGGACUUCGUCAAUUUCC-5' (SEQ ID NO: 469)
MET-2856 Target: 5'-TGATATTGACCCTGAAGCAGTTAAAGG-3' (SEQ ID NO: 829)

5'-UAUUGACCCUGAAGCAGUUAAAGgt-3'   (SEQ ID NO: 110)
                3'-CUAUAACUGGGACUUCGUCAAUUUCCA-5' (SEQ ID NO: 470)
MET-2857 Target: 5'-GATATTGACCCTGAAGCAGTTAAAGGT-3' (SEQ ID NO: 830)
```

TABLE 2-continued

Selected Human Anti-MET DsiRNA Agents (Asymmetrics)

```
            5'-AUUGACCCUGAAGCAGUUAAAGGtg-3'      (SEQ ID NO: 111)
            3'-UAUAACUGGGACUUCGUCAAUUUCCAC-5'    (SEQ ID NO: 471)
MET-2858 Target: 5'-ATATTGACCCTGAAGCAGTTAAAGGTG-3' (SEQ ID NO: 831)

5'-UUGACCCUGAAGCAGUUAAAGGUga-3'      (SEQ ID NO: 112)
            3'-AUAACUGGGACUUCGUCAAUUUCCACU-5'    (SEQ ID NO: 472)
MET-2859 Target: 5'-TATTGACCCTGAAGCAGTTAAAGGTGA-3' (SEQ ID NO: 832)

5'-UGACCCUGAAGCAGUUAAAGGUGaa-3'      (SEQ ID NO: 113)
            3'-UAACUGGGACUUCGUCAAUUUCCACUU-5'    (SEQ ID NO: 473)
MET-2860 Target: 5'-ATTGACCCTGAAGCAGTTAAAGGTGAA-3' (SEQ ID NO: 833)

5'-GACCCUGAAGCAGUUAAAGGUGAag-3'      (SEQ ID NO: 114)
            3'-AACUGGGACUUCGUCAAUUUCCACUUC-5'    (SEQ ID NO: 474)
MET-2861 Target: 5'-TTGACCCTGAAGCAGTTAAAGGTGAAG-3' (SEQ ID NO: 834)

5'-ACCCUGAAGCAGUUAAAGGUGAAgt-3'      (SEQ ID NO: 115)
            3'-ACUGGGACUUCGUCAAUUUCCACUUCA-5'    (SEQ ID NO: 475)
MET-2862 Target: 5'-TGACCCTGAAGCAGTTAAAGGTGAAGT-3' (SEQ ID NO: 835)

5'-CCCUGAAGCAGUUAAAGGUGAAGtg-3'      (SEQ ID NO: 116)
            3'-CUGGGACUUCGUCAAUUUCCACUUCAC-5'    (SEQ ID NO: 476)
MET-2863 Target: 5'-GACCCTGAAGCAGTTAAAGGTGAAGTG-3' (SEQ ID NO: 836)

5'-CCUGAAGCAGUUAAAGGUGAAGUgt-3'      (SEQ ID NO: 117)
            3'-UGGGACUUCGUCAAUUUCCACUUCACA-5'    (SEQ ID NO: 477)
MET-2864 Target: 5'-ACCCTGAAGCAGTTAAAGGTGAAGTGT-3' (SEQ ID NO: 837)

5'-CUGAAGCAGUUAAAGGUGAAGUGtt-3'      (SEQ ID NO: 118)
            3'-GGGACUUCGUCAAUUUCCACUUCACAA-5'    (SEQ ID NO: 478)
MET-2865 Target: 5'-CCCTGAAGCAGTTAAAGGTGAAGTGTT-3' (SEQ ID NO: 838)

5'-UGAAGCAGUUAAAGGUGAAGUGUta-3'      (SEQ ID NO: 119)
            3'-GGACUUCGUCAAUUUCCACUUCACAAU-5'    (SEQ ID NO: 479)
MET-2866 Target: 5'-CCTGAAGCAGTTAAAGGTGAAGTGTTA-3' (SEQ ID NO: 839)

5'-GAAGCAGUUAAAGGUGAAGUGUUaa-3'      (SEQ ID NO: 120)
            3'-GACUUCGUCAAUUUCCACUUCACAAUU-5'    (SEQ ID NO: 480)
MET-2867 Target: 5'-CTGAAGCAGTTAAAGGTGAAGTGTTAA-3' (SEQ ID NO: 840)

5'-AAGCAGUUAAAGGUGAAGUGUUAaa-3'      (SEQ ID NO: 121)
            3'-ACUUCGUCAAUUUCCACUUCACAAUUU-5'    (SEQ ID NO: 481)
MET-2868 Target: 5'-TGAAGCAGTTAAAGGTGAAGTGTTAAA-3' (SEQ ID NO: 841)

5'-AGCAGUUAAAGGUGAAGUGUUUAAaa-3'     (SEQ ID NO: 122)
            3'-CUUCGUCAAUUUCCACUUCACAAUUUU-5'    (SEQ ID NO: 482)
MET-2869 Target: 5'-GAAGCAGTTAAAGGTGAAGTGTTAAAA-3' (SEQ ID NO: 842)

5'-GCAGUUAAAGGUGAAGUGUUAAAag-3'      (SEQ ID NO: 123)
            3'-UUCGUCAAUUUCCACUUCACAAUUUUC-5'    (SEQ ID NO: 483)
MET-2870 Target: 5'-AAGCAGTTAAAGGTGAAGTGTTAAAAG-3' (SEQ ID NO: 843)

5'-CAGUUAAAGGUGAAGUGUUAAAAgt-3'      (SEQ ID NO: 124)
            3'-UCGUCAAUUUCCACUUCACAAUUUUCA-5'    (SEQ ID NO: 484)
MET-2871 Target: 5'-AGCAGTTAAAGGTGAAGTGTTAAAAGT-3' (SEQ ID NO: 844)

5'-AGUUAAAGGUGAAGUGUUAAAAGtt-3'      (SEQ ID NO: 125)
            3'-CGUCAAUUUCCACUUCACAAUUUUCAA-5'    (SEQ ID NO: 485)
MET-2872 Target: 5'-GCAGTTAAAGGTGAAGTGTTAAAAGTT-3' (SEQ ID NO: 845)

5'-GUUAAAGGUGAAGUGUUAAAAGUtg-3'      (SEQ ID NO: 126)
            3'-GUCAAUUUCCACUUCACAAUUUUCAAC-5'    (SEQ ID NO: 486)
MET-2873 Target: 5'-CAGTTAAAGGTGAAGTGTTAAAAGTTG-3' (SEQ ID NO: 846)

5'-UUAAAGGUGAAGUGUUAAAAGUUgg-3'      (SEQ ID NO: 127)
            3'-UCAAUUUCCACUUCACAAUUUUCAACC-5'    (SEQ ID NO: 487)
MET-2874 Target: 5'-AGTTAAAGGTGAAGTGTTAAAAGTTGG-3' (SEQ ID NO: 847)

5'-UAAAGGUGAAGUGUUAAAAGUUGga-3'      (SEQ ID NO: 128)
            3'-CAAUUUCCACUUCACAAUUUUCAACCU-5'    (SEQ ID NO: 488)
MET-2875 Target: 5'-GTTAAAGGTGAAGTGTTAAAAGTTGGA-3' (SEQ ID NO: 848)

5'-AAAGGUGAAGUGUUAAAAGUUGGaa-3'      (SEQ ID NO: 129)
            3'-AAUUUCCACUUCACAAUUUUCAACCUU-5'    (SEQ ID NO: 489)
MET-2876 Target: 5'-TTAAAGGTGAAGTGTTAAAAGTTGGAA-3' (SEQ ID NO: 849)
```

TABLE 2-continued

Selected Human Anti-MET DsiRNA Agents (Asymmetrics)

```
              5'-AAGGUGAAGUGUUAAAAGUUGGAaa-3'   (SEQ ID NO: 130)
              3'-AUUUCCACUUCACAAUUUUCAACCUUU-5' (SEQ ID NO: 490)
MET-2877 Target: 5'-TAAAGGTGAAGTGTTAAAAGTTGGAAA-3' (SEQ ID NO: 850)

5'-AGGUGAAGUGUUAAAAGUUGGAAat-3'   (SEQ ID NO: 131)
              3'-UUUCCACUUCACAAUUUUCAACCUUUA-5' (SEQ ID NO: 491)
MET-2878 Target: 5'-AAAGGTGAAGTGTTAAAAGTTGGAAAT-3' (SEQ ID NO: 851)

5'-GGUGAAGUGUUAAAAGUUGGAAAta-3'   (SEQ ID NO: 132)
              3'-UUCCACUUCACAAUUUUCAACCUUUAU-5' (SEQ ID NO: 492)
MET-2879 Target: 5'-AAGGTGAAGTGTTAAAAGTTGGAAATA-3' (SEQ ID NO: 852)

5'-GUGAAGUGUUAAAAGUUGGAAAUaa-3'   (SEQ ID NO: 133)
              3'-UCCACUUCACAAUUUUCAACCUUUAUU-5' (SEQ ID NO: 493)
MET-2880 Target: 5'-AGGTGAAGTGTTAAAAGTTGGAAATAA-3' (SEQ ID NO: 853)

5'-UGAAGUGUUAAAAGUUGGAAAUAag-3'   (SEQ ID NO: 134)
              3'-CCACUUCACAAUUUUCAACCUUUAUUC-5' (SEQ ID NO: 494)
MET-2881 Target: 5'-GGTGAAGTGTTAAAAGTTGGAAATAAG-3' (SEQ ID NO: 854)

5'-GAAGUGUUAAAAGUUGGAAAUAAga-3'   (SEQ ID NO: 135)
              3'-CACUUCACAAUUUUCAACCUUUAUUCU-5' (SEQ ID NO: 495)
MET-2882 Target: 5'-GTGAAGTGTTAAAAGTTGGAAATAAGA-3' (SEQ ID NO: 855)

5'-AAGUGUUAAAAGUUGGAAAUAAGag-3'   (SEQ ID NO: 136)
              3'-ACUUCACAAUUUUCAACCUUUAUUCUC-5' (SEQ ID NO: 496)
MET-2883 Target: 5'-TGAAGTGTTAAAAGTTGGAAATAAGAG-3' (SEQ ID NO: 856)

5'-AGUGUUAAAAGUUGGAAAUAAGAgc-3'   (SEQ ID NO: 137)
              3'-CUUCACAAUUUUCAACCUUUAUUCUCG-5' (SEQ ID NO: 497)
MET-2884 Target: 5'-GAAGTGTTAAAAGTTGGAAATAAGAGC-3' (SEQ ID NO: 857)

5'-UGAACAGCGAGCUAAAUAUAGAGtg-3'   (SEQ ID NO: 138)
              3'-UAACUUGUCGCUCGAUUUAUAUCUCAC-5' (SEQ ID NO: 498)
MET-2973 Target: 5'-ATTGAACAGCGAGCTAAATATAGAGTG-3' (SEQ ID NO: 858)

5'-GAACAGCGAGCUAAAUAUAGAGUgg-3'   (SEQ ID NO: 139)
              3'-AACUUGUCGCUCGAUUUAUAUCUCACC-5' (SEQ ID NO: 499)
MET-2974 Target: 5'-TTGAACAGCGAGCTAAATATAGAGTGG-3' (SEQ ID NO: 859)

5'-AACAGCGAGCUAAAUAUAGAGUGga-3'   (SEQ ID NO: 140)
              3'-ACUUGUCGCUCGAUUUAUAUCUCACCU-5' (SEQ ID NO: 500)
MET-2975 Target: 5'-TGAACAGCGAGCTAAATATAGAGTGGA-3' (SEQ ID NO: 860)

5'-ACAGCGAGCUAAAUAUAGAGUGGaa-3'   (SEQ ID NO: 141)
              3'-CUUGUCGCUCGAUUUAUAUCUCACCUU-5' (SEQ ID NO: 501)
MET-2976 Target: 5'-GAACAGCGAGCTAAATATAGAGTGGAA-3' (SEQ ID NO: 861)

5'-CAGCGAGCUAAAUAUAGAGUGGAag-3'   (SEQ ID NO: 142)
              3'-UUGUCGCUCGAUUUAUAUCUCACCUUC-5' (SEQ ID NO: 502)
MET-2977 Target: 5'-AACAGCGAGCTAAATATAGAGTGGAAG-3' (SEQ ID NO: 862)

5'-AGCGAGCUAAAUAUAGAGUGGAAgc-3'   (SEQ ID NO: 143)
              3'-UGUCGCUCGAUUUAUAUCUCACCUUCG-5' (SEQ ID NO: 503)
MET-2978 Target: 5'-ACAGCGAGCTAAATATAGAGTGGAAGC-3' (SEQ ID NO: 863)

5'-GCGAGCUAAAUAUAGAGUGGAAGca-3'   (SEQ ID NO: 144)
              3'-GUCGCUCGAUUUAUAUCUCACCUUCGU-5' (SEQ ID NO: 504)
MET-2979 Target: 5'-CAGCGAGCTAAATATAGAGTGGAAGCA-3' (SEQ ID NO: 864)

5'-CGAGCUAAAUAUAGAGUGGAAGCaa-3'   (SEQ ID NO: 145)
              3'-UCGCUCGAUUUAUAUCUCACCUUCGUU-5' (SEQ ID NO: 505)
MET-2980 Target: 5'-AGCGAGCTAAATATAGAGTGGAAGCAA-3' (SEQ ID NO: 865)

5'-GAGCUAAAUAUAGAGUGGAAGCAag-3'   (SEQ ID NO: 146)
              3'-CGCUCGAUUUAUAUCUCACCUUCGUUC-5' (SEQ ID NO: 506)
MET-2981 Target: 5'-GCGAGCTAAATATAGAGTGGAAGCAAG-3' (SEQ ID NO: 866)

5'-AGCUAAAUAUAGAGUGGAAGCAAgc-3'   (SEQ ID NO: 147)
              3'-GCUCGAUUUAUAUCUCACCUUCGUUCG-5' (SEQ ID NO: 507)
MET-2982 Target: 5'-CGAGCTAAATATAGAGTGGAAGCAAGC-3' (SEQ ID NO: 867)

5'-GCUAAAUAUAGAGUGGAAGCAAGca-3'   (SEQ ID NO: 148)
              3'-CUCGAUUUAUAUCUCACCUUCGUUCGU-5' (SEQ ID NO: 508)
MET-2983 Target: 5'-GAGCTAAATATAGAGTGGAAGCAAGCA-3' (SEQ ID NO: 868)
```

TABLE 2-continued

Selected Human Anti-MET DsiRNA Agents (Asymmetrics)

```
              5'-CUAAAUAUAGAGUGGAAGCAAGCaa-3'     (SEQ ID NO: 149)
              3'-UCGAUUUAUAUCUCACCUUCGUUCGUU-5'   (SEQ ID NO: 509)
MET-2984 Target: 5'-AGCTAAATATAGAGTGGAAGCAAGCAA-3' (SEQ ID NO: 869)

5'-UAAAUAUAGAGUGGAAGCAAGCAat-3'     (SEQ ID NO: 150)
              3'-CGAUUUAUAUCUCACCUUCGUUCGUUA-5'   (SEQ ID NO: 510)
MET-2985 Target: 5'-GCTAAATATAGAGTGGAAGCAAGCAAT-3' (SEQ ID NO: 870)

5'-AAAUAUAGAGUGGAAGCAAGCAAtt-3'     (SEQ ID NO: 151)
              3'-GAUUUAUAUCUCACCUUCGUUCGUUAA-5'   (SEQ ID NO: 511)
MET-2986 Target: 5'-CTAAATATAGAGTGGAAGCAAGCAATT-3' (SEQ ID NO: 871)

5'-AAUAUAGAGUGGAAGCAAGCAAUtt-3'     (SEQ ID NO: 152)
              3'-AUUUAUAUCUCACCUUCGUUCGUUAAA-5'   (SEQ ID NO: 512)
MET-2987 Target: 5'-TAAATATAGAGTGGAAGCAAGCAATTT-3' (SEQ ID NO: 872)

5'-AUAUAGAGUGGAAGCAAGCAAUUtc-3'     (SEQ ID NO: 153)
              3'-UUUAUAUCUCACCUUCGUUCGUUAAAG-5'   (SEQ ID NO: 513)
MET-2988 Target: 5'-AAATATAGAGTGGAAGCAAGCAATTTC-3' (SEQ ID NO: 873)

5'-UAUAGAGUGGAAGCAAGCAAUUUct-3'     (SEQ ID NO: 154)
              3'-UUAUAUCUCACCUUCGUUCGUUAAAGA-5'   (SEQ ID NO: 514)
MET-2989 Target: 5'-AATATAGAGTGGAAGCAAGCAATTTCT-3' (SEQ ID NO: 874)

5'-UGGGUUUUUCCUGUGGCUGAAAAag-3'     (SEQ ID NO: 155)
              3'-GAACCCAAAAAGGACACCGACUUUUUC-5'   (SEQ ID NO: 515)
MET-3112 Target: 5'-CTTGGGTTTTTCCTGTGGCTGAAAAAG-3' (SEQ ID NO: 875)

5'-GGCUGAAAAAGAGAAAGCAAAUUaa-3'     (SEQ ID NO: 156)
              3'-CACCGACUUUUUCUCUUUCGUUUAAUU-5'   (SEQ ID NO: 516)
MET-3126 Target: 5'-GTGGCTGAAAAAGAGAAAGCAAATTAA-3' (SEQ ID NO: 876)

5'-UAAAGAUCUGGGCAGUGAAUUAGtt-3'     (SEQ ID NO: 157)
              3'-UAAUUUCUAGACCCGUCACUUAAUCAA-5'   (SEQ ID NO: 517)
MET-3148 Target: 5'-ATTAAAGATCTGGGCAGTGAATTAGTT-3' (SEQ ID NO: 877)

5'-AAAGAUCUGGGCAGUGAAUUAGUtc-3'     (SEQ ID NO: 158)
              3'-AAUUUCUAGACCCGUCACUUAAUCAAG-5'   (SEQ ID NO: 518)
MET-3149 Target: 5'-TTAAAGATCTGGGCAGTGAATTAGTTC-3' (SEQ ID NO: 878)

5'-AAGAUCUGGGCAGUGAAUUAGUUcg-3'     (SEQ ID NO: 159)
              3'-AUUUCUAGACCCGUCACUUAAUCAAGC-5'   (SEQ ID NO: 519)
MET-3150 Target: 5'-TAAAGATCTGGGCAGTGAATTAGTTCG-3' (SEQ ID NO: 879)

5'-AGAUCUGGGCAGUGAAUUAGUUCgc-3'     (SEQ ID NO: 160)
              3'-UUUCUAGACCCGUCACUUAAUCAAGCG-5'   (SEQ ID NO: 520)
MET-3151 Target: 5'-AAAGATCTGGGCAGTGAATTAGTTCGC-3' (SEQ ID NO: 880)

5'-GAUCUGGGCAGUGAAUUAGUUCGct-3'     (SEQ ID NO: 161)
              3'-UUCUAGACCCGUCACUUAAUCAAGCGA-5'   (SEQ ID NO: 521)
MET-3152 Target: 5'-AAGATCTGGGCAGTGAATTAGTTCGCT-3' (SEQ ID NO: 881)

5'-AUCUGGGCAGUGAAUUAGUUCGCta-3'     (SEQ ID NO: 162)
              3'-UCUAGACCCGUCACUUAAUCAAGCGAU-5'   (SEQ ID NO: 522)
MET-3153 Target: 5'-AGATCTGGGCAGTGAATTAGTTCGCTA-3' (SEQ ID NO: 882)

5'-UCUGGGCAGUGAAUUAGUUCGCUac-3'     (SEQ ID NO: 163)
              3'-CUAGACCCGUCACUUAAUCAAGCGAUG-5'   (SEQ ID NO: 523)
MET-3154 Target: 5'-GATCTGGGCAGTGAATTAGTTCGCTAC-3' (SEQ ID NO: 883)

5'-CUGGGCAGUGAAUUAGUUCGCUAcg-3'     (SEQ ID NO: 164)
              3'-UAGACCCGUCACUUAAUCAAGCGAUGC-5'   (SEQ ID NO: 524)
MET-3155 Target: 5'-ATCTGGGCAGTGAATTAGTTCGCTACG-3' (SEQ ID NO: 884)

5'-UGGGCAGUGAAUUAGUUCGCUACga-3'     (SEQ ID NO: 165)
              3'-AGACCCGUCACUUAAUCAAGCGAUGCU-5'   (SEQ ID NO: 525)
MET-3156 Target: 5'-TCTGGGCAGTGAATTAGTTCGCTACGA-3' (SEQ ID NO: 885)

5'-GGGCAGUGAAUUAGUUCGCUACGat-3'     (SEQ ID NO: 166)
              3'-GACCCGUCACUUAAUCAAGCGAUGCUA-5'   (SEQ ID NO: 526)
MET-3157 Target: 5'-CTGGGCAGTGAATTAGTTCGCTACGAT-3' (SEQ ID NO: 886)

5'-GGCAGUGAAUUAGUUCGCUACGAtg-3'     (SEQ ID NO: 167)
              3'-ACCCGUCACUUAAUCAAGCGAUGCUAC-5'   (SEQ ID NO: 527)
MET-3158 Target: 5'-TGGGCAGTGAATTAGTTCGCTACGATG-3' (SEQ ID NO: 887)
```

TABLE 2-continued

Selected Human Anti-MET DsiRNA Agents (Asymmetrics)

```
                  5'-GCAGUGAAUUAGUUCGCUACGAUgc-3'       (SEQ ID NO: 168)
                  3'-CCCGUCACUUAAUCAAGCGAUGCUACG-5'     (SEQ ID NO: 528)
MET-3159 Target:  5'-GGGCAGTGAATTAGTTCGCTACGATGC-3'     (SEQ ID NO: 888)

5'-CACUCCUCAUUUGGAUAGGCUUGta-3'       (SEQ ID NO: 169)
                  3'-GUGUGAGGAGUAAACCUAUCCGAACAU-5'     (SEQ ID NO: 529)
MET-3193 Target:  5'-CACACTCCTCATTTGGATAGGCTTGTA-3'     (SEQ ID NO: 889)

5'-ACUCCUCAUUUGGAUAGGCUUGUaa-3'       (SEQ ID NO: 170)
                  3'-UGUGAGGAGUAAACCUAUCCGAACAUU-5'     (SEQ ID NO: 530)
MET-3194 Target:  5'-ACACTCCTCATTTGGATAGGCTTGTAA-3'    (SEQ ID NO: 890)

5'-CUCCUCAUUUGGAUAGGCUUGUAag-3'       (SEQ ID NO: 171)
                  3'-GUGAGGAGUAAACCUAUCCGAACAUUC-5'     (SEQ ID NO: 531)
MET-3195 Target:  5'-CACTCCTCATTTGGATAGGCTTGTAAG-3'    (SEQ ID NO: 891)

5'-UCCUCAUUUGGAUAGGCUUGUAAgt-3'       (SEQ ID NO: 172)
                  3'-UGAGGAGUAAACCUAUCCGAACAUUCA-5'     (SEQ ID NO: 532)
MET-3196 Target:  5'-ACTCCTCATTTGGATAGGCTTGTAAGT-3'    (SEQ ID NO: 892)

5'-CCUCAUUUGGAUAGGCUUGUAAGtg-3'       (SEQ ID NO: 173)
                  3'-GAGGAGUAAACCUAUCCGAACAUUCAC-5'     (SEQ ID NO: 533)
MET-3197 Target:  5'-CTCCTCATTTGGATAGGCTTGTAAGTG-3'    (SEQ ID NO: 893)

5'-CUCAUUUGGAUAGGCUUGUAAGUgc-3'       (SEQ ID NO: 174)
                  3'-AGGAGUAAACCUAUCCGAACAUUCACG-5'     (SEQ ID NO: 534)
MET-3198 Target:  5'-TCCTCATTTGGATAGGCTTGTAAGTGC-3'    (SEQ ID NO: 894)

5'-UCAUUUGGAUAGGCUUGUAAGUGcc-3'       (SEQ ID NO: 175)
                  3'-GGAGUAAACCUAUCCGAACAUUCACGG-5'     (SEQ ID NO: 535)
MET-3199 Target:  5'-CCTCATTTGGATAGGCTTGTAAGTGCC-3'    (SEQ ID NO: 895)

5'-CAUUUGGAUAGGCUUGUAAGUGCcc-3'       (SEQ ID NO: 176)
                  3'-GAGUAAACCUAUCCGAACAUUCACGGG-5'     (SEQ ID NO: 536)
MET-3200 Target:  5'-CTCATTTGGATAGGCTTGTAAGTGCCC-3'    (SEQ ID NO: 896)

5'-AUUUGGAUAGGCUUGUAAGUGCCcg-3'       (SEQ ID NO: 177)
                  3'-AGUAAACCUAUCCGAACAUUCACGGGC-5'     (SEQ ID NO: 537)
MET-3201 Target:  5'-TCATTTGGATAGGCTTGTAAGTGCCCG-3'    (SEQ ID NO: 897)

5'-UUUGGAUAGGCUUGUAAGUGCCCga-3'       (SEQ ID NO: 178)
                  3'-GUAAACCUAUCCGAACAUUCACGGGCU-5'     (SEQ ID NO: 538)
MET-3202 Target:  5'-CATTTGGATAGGCTTGTAAGTGCCCGA-3'    (SEQ ID NO: 898)

5'-UUGGAUAGGCUUGUAAGUGCCCGaa-3'       (SEQ ID NO: 179)
                  3'-UAAACCUAUCCGAACAUUCACGGGCUU-5'     (SEQ ID NO: 539)
MET-3203 Target:  5'-ATTTGGATAGGCTTGTAAGTGCCCGAA-3'    (SEQ ID NO: 899)

5'-UGGAUAGGCUUGUAAGUGCCCGAag-3'       (SEQ ID NO: 180)
                  3'-AAACCUAUCCGAACAUUCACGGGCUUC-5'     (SEQ ID NO: 540)
MET-3204 Target:  5'-TTTGGATAGGCTTGTAAGTGCCCGAAG-3'    (SEQ ID NO: 900)

5'-GGAUAGGCUUGUAAGUGCCCGAAgt-3'       (SEQ ID NO: 181)
                  3'-AACCUAUCCGAACAUUCACGGGCUUCA-5'     (SEQ ID NO: 541)
MET-3205 Target:  5'-TTGGATAGGCTTGTAAGTGCCCGAAGT-3'    (SEQ ID NO: 901)

5'-GAUAGGCUUGUAAGUGCCCGAAGtg-3'       (SEQ ID NO: 182)
                  3'-ACCUAUCCGAACAUUCACGGGCUUCAC-5'     (SEQ ID NO: 542)
MET-3206 Target:  5'-TGGATAGGCTTGTAAGTGCCCGAAGTG-3'    (SEQ ID NO: 902)

5'-AUAGGCUUGUAAGUGCCCGAAGUgt-3'       (SEQ ID NO: 183)
                  3'-CCUAUCCGAACAUUCACGGGCUUCACA-5'     (SEQ ID NO: 543)
MET-3207 Target:  5'-GGATAGGCTTGTAAGTGCCCGAAGTGT-3'    (SEQ ID NO: 903)

5'-UAGGCUUGUAAGUGCCCGAAGUGta-3'       (SEQ ID NO: 184)
                  3'-CUAUCCGAACAUUCACGGGCUUCACAU-5'     (SEQ ID NO: 544)
MET-3208 Target:  5'-GATAGGCTTGTAAGTGCCCGAAGTGTA-3'    (SEQ ID NO: 904)

5'-AGGCUUGUAAGUGCCCGAAGUGUaa-3'       (SEQ ID NO: 185)
                  3'-UAUCCGAACAUUCACGGGCUUCACAUU-5'     (SEQ ID NO: 545)
MET-3209 Target:  5'-ATAGGCTTGTAAGTGCCCGAAGTGTAA-3'    (SEQ ID NO: 905)
```

TABLE 2-continued

Selected Human Anti-MET DsiRNA Agents (Asymmetrics)

```
              5'-GGCUUGUAAGUGCCCGAAGUGUAag-3'    (SEQ ID NO: 186)
              3'-AUCCGAACAUUCACGGGCUUCACAUUC-5'  (SEQ ID NO: 546)
MET-3210 Target: 5'-TAGGCTTGTAAGTGCCCGAAGTGTAAG-3' (SEQ ID NO: 906)

5'-GCUUGUAAGUGCCCGAAGUGUAAgc-3'    (SEQ ID NO: 187)
              3'-UCCGAACAUUCACGGGCUUCACAUUCG-5'  (SEQ ID NO: 547)
MET-3211 Target: 5'-AGGCTTGTAAGTGCCCGAAGTGTAAGC-3' (SEQ ID NO: 907)

5'-CUUGUAAGUGCCCGAAGUGUAAGcc-3'    (SEQ ID NO: 188)
              3'-CCGAACAUUCACGGGCUUCACAUUCGG-5'  (SEQ ID NO: 548)
MET-3212 Target: 5'-GGCTTGTAAGTGCCCGAAGTGTAAGCC-3' (SEQ ID NO: 908)

5'-UUGUAAGUGCCCGAAGUGUAAGCcc-3'    (SEQ ID NO: 189)
              3'-CGAACAUUCACGGGCUUCACAUUCGGG-5'  (SEQ ID NO: 549)
MET-3213 Target: 5'-GCTTGTAAGTGCCCGAAGTGTAAGCCC-3' (SEQ ID NO: 909)

5'-UGUAAGUGCCCGAAGUGUAAGCCca-3'    (SEQ ID NO: 190)
              3'-GAACAUUCACGGGCUUCACAUUCGGGU-5'  (SEQ ID NO: 550)
MET-3214 Target: 5'-CTTGTAAGTGCCCGAAGTGTAAGCCCA-3' (SEQ ID NO: 910)

5'-GUAAGUGCCCGAAGUGUAAGCCCaa-3'    (SEQ ID NO: 191)
              3'-AACAUUCACGGGCUUCACAUUCGGGUU-5'  (SEQ ID NO: 551)
MET-3215 Target: 5'-TTGTAAGTGCCCGAAGTGTAAGCCCAA-3' (SEQ ID NO: 911)

5'-UAAGUGCCCGAAGUGUAAGCCCAac-3'    (SEQ ID NO: 192)
              3'-ACAUUCACGGGCUUCACAUUCGGGUUG-5'  (SEQ ID NO: 552)
MET-3216 Target: 5'-TGTAAGTGCCCGAAGTGTAAGCCCAAC-3' (SEQ ID NO: 912)

5'-GAGCUACUUUUCCAGAAGAUCAGtt-3'    (SEQ ID NO: 193)
              3'-GGCUCGAUGAAAAGGUCUUCUAGUCAA-5'  (SEQ ID NO: 553)
MET-3276 Target: 5'-CCGAGCTACTTTTCCAGAAGATCAGTT-3' (SEQ ID NO: 913)

5'-CACAUUGACCUCAGUGCUCUAAAtc-3'    (SEQ ID NO: 194)
              3'-AGGUGUAACUGGAGUCACGAGAUUUAG-5'  (SEQ ID NO: 554)
MET-3419 Target: 5'-TCCACATTGACCTCAGTGCTCTAAATC-3' (SEQ ID NO: 914)

5'-ACAUUGACCUCAGUGCUCUAAAUcc-3'    (SEQ ID NO: 195)
              3'-GGUGUAACUGGAGUCACGAGAUUUAGG-5'  (SEQ ID NO: 555)
MET-3420 Target: 5'-CCACATTGACCTCAGTGCTCTAAATCC-3' (SEQ ID NO: 915)

5'-CAUUGACCUCAGUGCUCUAAAUCca-3'    (SEQ ID NO: 196)
              3'-GUGUAACUGGAGUCACGAGAUUUAGGU-5'  (SEQ ID NO: 556)
MET-3421 Target: 5'-CACATTGACCTCAGTGCTCTAAATCCA-3' (SEQ ID NO: 916)

5'-AUUGACCUCAGUGCUCUAAAUCCag-3'    (SEQ ID NO: 197)
              3'-UGUAACUGGAGUCACGAGAUUUAGGUC-5'  (SEQ ID NO: 557)
MET-3422 Target: 5'-ACATTGACCTCAGTGCTCTAAATCCAG-3' (SEQ ID NO: 917)

5'-UUGACCUCAGUGCUCUAAAUCCAga-3'    (SEQ ID NO: 198)
              3'-GUAACUGGAGUCACGAGAUUUAGGUCU-5'  (SEQ ID NO: 558)
MET-3423 Target: 5'-CATTGACCTCAGTGCTCTAAATCCAGA-3' (SEQ ID NO: 918)

5'-UGACCUCAGUGCUCUAAAUCCAGag-3'    (SEQ ID NO: 199)
              3'-UAACUGGAGUCACGAGAUUUAGGUCUC-5'  (SEQ ID NO: 559)
MET-3424 Target: 5'-ATTGACCTCAGTGCTCTAAATCCAGAG-3' (SEQ ID NO: 919)

5'-GACCUCAGUGCUCUAAAUCCAGAgc-3'    (SEQ ID NO: 200)
              3'-AACUGGAGUCACGAGAUUUAGGUCUCG-5'  (SEQ ID NO: 560)
MET-3425 Target: 5'-TTGACCTCAGTGCTCTAAATCCAGAGC-3' (SEQ ID NO: 920)

5'-ACCUCAGUGCUCUAAAUCCAGAGct-3'    (SEQ ID NO: 201)
              3'-ACUGGAGUCACGAGAUUUAGGUCUCGA-5'  (SEQ ID NO: 561)
MET-3426 Target: 5'-TGACCTCAGTGCTCTAAATCCAGAGCT-3' (SEQ ID NO: 921)

5'-CCUCAGUGCUCUAAAUCCAGAGCtg-3'    (SEQ ID NO: 202)
              3'-CUGGAGUCACGAGAUUUAGGUCUCGAC-5'  (SEQ ID NO: 562)
MET-3427 Target: 5'-GACCTCAGTGCTCTAAATCCAGAGCTG-3' (SEQ ID NO: 922)

5'-CUCAGUGCUCUAAAUCCAGAGCUgg-3'    (SEQ ID NO: 203)
              3'-UGGAGUCACGAGAUUUAGGUCUCGACC-5'  (SEQ ID NO: 563)
MET-3428 Target: 5'-ACCTCAGTGCTCTAAATCCAGAGCTGG-3' (SEQ ID NO: 923)
```

TABLE 2-continued

Selected Human Anti-MET DsiRNA Agents (Asymmetrics)

```
                 5'-UCAGUGCUCUAAAUCCAGAGCUGgt-3'    (SEQ ID NO: 204)
                 3'-GGAGUCACGAGAUUUAGGUCUCGACCA-5'  (SEQ ID NO: 564)
MET-3429 Target: 5'-CCTCAGTGCTCTAAATCCAGAGCTGGT-3'  (SEQ ID NO: 924)

5'-CAGUGCUCUAAAUCCAGAGCUGGtc-3'    (SEQ ID NO: 205)
                 3'-GAGUCACGAGAUUUAGGUCUCGACCAG-5'  (SEQ ID NO: 565)
MET-3430 Target: 5'-CTCAGTGCTCTAAATCCAGAGCTGGTC-3'  (SEQ ID NO: 925)

5'-AGUGCUCUAAAUCCAGAGCUGGUcc-3'    (SEQ ID NO: 206)
                 3'-AGUCACGAGAUUUAGGUCUCGACCAGG-5'  (SEQ ID NO: 566)
MET-3431 Target: 5'-TCAGTGCTCTAAATCCAGAGCTGGTCC-3'  (SEQ ID NO: 926)

5'-GUGCUCUAAAUCCAGAGCUGGUCca-3'    (SEQ ID NO: 207)
                 3'-GUCACGAGAUUUAGGUCUCGACCAGGU-5'  (SEQ ID NO: 567)
MET-3432 Target: 5'-CAGTGCTCTAAATCCAGAGCTGGTCCA-3'  (SEQ ID NO: 927)

5'-UGCUCUAAAUCCAGAGCUGGUCCag-3'    (SEQ ID NO: 208)
                 3'-UCACGAGAUUUAGGUCUCGACCAGGUC-5'  (SEQ ID NO: 568)
MET-3433 Target: 5'-AGTGCTCTAAATCCAGAGCTGGTCCAG-3'  (SEQ ID NO: 928)

5'-GCUCUAAAUCCAGAGCUGGUCCAgg-3'    (SEQ ID NO: 209)
                 3'-CACGAGAUUUAGGUCUCGACCAGGUCC-5'  (SEQ ID NO: 569)
MET-3434 Target: 5'-GTGCTCTAAATCCAGAGCTGGTCCAGG-3'  (SEQ ID NO: 929)

5'-CUCUAAAUCCAGAGCUGGUCCAGgc-3'    (SEQ ID NO: 210)
                 3'-ACGAGAUUUAGGUCUCGACCAGGUCCG-5'  (SEQ ID NO: 570)
MET-3435 Target: 5'-TGCTCTAAATCCAGAGCTGGTCCAGGC-3'  (SEQ ID NO: 930)

5'-UCUAAAUCCAGAGCUGGUCCAGGca-3'    (SEQ ID NO: 211)
                 3'-CGAGAUUUAGGUCUCGACCAGGUCCGU-5'  (SEQ ID NO: 571)
MET-3436 Target: 5'-GCTCTAAATCCAGAGCTGGTCCAGGCA-3'  (SEQ ID NO: 931)

5'-CUAAAUCCAGAGCUGGUCCAGGCag-3'    (SEQ ID NO: 212)
                 3'-GAGAUUUAGGUCUCGACCAGGUCCGUC-5'  (SEQ ID NO: 572)
MET-3437 Target: 5'-CTCTAAATCCAGAGCTGGTCCAGGCAG-3'  (SEQ ID NO: 932)

5'-UAAAUCCAGAGCUGGUCCAGGCAgt-3'    (SEQ ID NO: 213)
                 3'-AGAUUUAGGUCUCGACCAGGUCCGUCA-5'  (SEQ ID NO: 573)
MET-3438 Target: 5'-TCTAAATCCAGAGCTGGTCCAGGCAGT-3'  (SEQ ID NO: 933)

5'-AGCCUGAUUGUGCAUUUCAAUGAag-3'    (SEQ ID NO: 214)
                 3'-CAUCGGACUAACACGUAAAGUUACUUC-5'  (SEQ ID NO: 574)
MET-3488 Target: 5'-GTAGCCTGATTGTGCATTTCAATGAAG-3'  (SEQ ID NO: 934)

5'-GCCUGAUUGUGCAUUUCAAUGAAgt-3'    (SEQ ID NO: 215)
                 3'-AUCGGACUAACACGUAAAGUUACUUCA-5'  (SEQ ID NO: 575)
MET-3489 Target: 5'-TAGCCTGATTGTGCATTTCAATGAAGT-3'  (SEQ ID NO: 935)

5'-CCUGAUUGUGCAUUUCAAUGAAGtc-3'    (SEQ ID NO: 216)
                 3'-UCGGACUAACACGUAAAGUUACUUCAG-5'  (SEQ ID NO: 576)
MET-3490 Target: 5'-AGCCTGATTGTGCATTTCAATGAAGTC-3'  (SEQ ID NO: 936)

5'-CUGAUUGUGCAUUUCAAUGAAGUca-3'    (SEQ ID NO: 217)
                 3'-CGGACUAACACGUAAAGUUACUUCAGU-5'  (SEQ ID NO: 577)
MET-3491 Target: 5'-GCCTGATTGTGCATTTCAATGAAGTCA-3'  (SEQ ID NO: 937)

5'-UGAUUGUGCAUUUCAAUGAAGUCat-3'    (SEQ ID NO: 218)
                 3'-GGACUAACACGUAAAGUUACUUCAGUA-5'  (SEQ ID NO: 578)
MET-3492 Target: 5'-CCTGATTGTGCATTTCAATGAAGTCAT-3'  (SEQ ID NO: 938)

5'-GAUUGUGCAUUUCAAUGAAGUCAta-3'    (SEQ ID NO: 219)
                 3'-GACUAACACGUAAAGUUACUUCAGUAU-5'  (SEQ ID NO: 579)
MET-3493 Target: 5'-CTGATTGTGCATTTCAATGAAGTCATA-3'  (SEQ ID NO: 939)
```

TABLE 2-continued

Selected Human Anti-MET DsiRNA Agents (Asymmetrics)

```
              5'-AUUGUGCAUUUCAAUGAAGUCAUag-3'       (SEQ ID NO: 220)
              3'-ACUAACACGUAAAGUUACUUCAGUAUC-5'     (SEQ ID NO: 580)
MET-3494 Target: 5'-TGATTGTGCATTTCAATGAAGTCATAG-3'  (SEQ ID NO: 940)

5'-UUGUGCAUUUCAAUGAAGUCAUAgg-3'      (SEQ ID NO: 221)
              3'-CUAACACGUAAAGUUACUUCAGUAUCC-5'    (SEQ ID NO: 581)
MET-3495 Target: 5'-GATTGTGCATTTCAATGAAGTCATAGG-3' (SEQ ID NO: 941)

5'-UGUGCAUUUCAAUGAAGUCAUAGga-3'      (SEQ ID NO: 222)
              3'-UAACACGUAAAGUUACUUCAGUAUCCU-5'    (SEQ ID NO: 582)
MET-3496 Target: 5'-ATTGTGCATTTCAATGAAGTCATAGGA-3' (SEQ ID NO: 942)

5'-GUGCAUUUCAAUGAAGUCAUAGGaa-3'      (SEQ ID NO: 223)
              3'-AACACGUAAAGUUACUUCAGUAUCCUU-5'    (SEQ ID NO: 583)
MET-3497 Target: 5'-TTGTGCATTTCAATGAAGTCATAGGAA-3' (SEQ ID NO: 943)

5'-UGCAUUUCAAUGAAGUCAUAGGAag-3'      (SEQ ID NO: 224)
              3'-ACACGUAAAGUUACUUCAGUAUCCUUC-5'    (SEQ ID NO: 584)
MET-3498 Target: 5'-TGTGCATTTCAATGAAGTCATAGGAAG-3' (SEQ ID NO: 944)

5'-GCAUUUCAAUGAAGUCAUAGGAAga-3'      (SEQ ID NO: 225)
              3'-CACGUAAAGUUACUUCAGUAUCCUUCU-5'    (SEQ ID NO: 585)
MET-3499 Target: 5'-GTGCATTTCAATGAAGTCATAGGAAGA-3' (SEQ ID NO: 945)

5'-CAUUUCAAUGAAGUCAUAGGAAGag-3'      (SEQ ID NO: 226)
              3'-ACGUAAAGUUACUUCAGUAUCCUUCUC-5'    (SEQ ID NO: 586)
MET-3500 Target: 5'-TGCATTTCAATGAAGTCATAGGAAGAG-3' (SEQ ID NO: 946)

5'-AUUUCAAUGAAGUCAUAGGAAGAgg-3'      (SEQ ID NO: 227)
              3'-CGUAAAGUUACUUCAGUAUCCUUCUCC-5'    (SEQ ID NO: 587)
MET-3501 Target: 5'-GCATTTCAATGAAGTCATAGGAAGAGG-3' (SEQ ID NO: 947)

5'-UUUCAAUGAAGUCAUAGGAAGAGgg-3'      (SEQ ID NO: 228)
              3'-GUAAAGUUACUUCAGUAUCCUUCUCCC-5'    (SEQ ID NO: 588)
MET-3502 Target: 5'-CATTTCAATGAAGTCATAGGAAGAGGG-3' (SEQ ID NO: 948)

5'-UUCAAUGAAGUCAUAGGAAGAGGgc-3'      (SEQ ID NO: 229)
              3'-UAAAGUUACUUCAGUAUCCUUCUCCCG-5'    (SEQ ID NO: 589)
MET-3503 Target: 5'-ATTTCAATGAAGTCATAGGAAGAGGGC-3' (SEQ ID NO: 949)

5'-UCAAUGAAGUCAUAGGAAGAGGGca-3'      (SEQ ID NO: 230)
              3'-AAAGUUACUUCAGUAUCCUUCUCCCGU-5'    (SEQ ID NO: 590)
MET-3504 Target: 5'-TTTCAATGAAGTCATAGGAAGAGGGCA-3' (SEQ ID NO: 950)

5'-CAAUGAAGUCAUAGGAAGAGGGCat-3'      (SEQ ID NO: 231)
              3'-AAGUUACUUCAGUAUCCUUCUCCCGUA-5'    (SEQ ID NO: 591)
MET-3505 Target: 5'-TTCAATGAAGTCATAGGAAGAGGGCAT-3' (SEQ ID NO: 951)

5'-AAUGAAGUCAUAGGAAGAGGGCAtt-3'      (SEQ ID NO: 232)
              3'-AGUUACUUCAGUAUCCUUCUCCCGUAA-5'    (SEQ ID NO: 592)
MET-3506 Target: 5'-TCAATGAAGTCATAGGAAGAGGGCATT-3' (SEQ ID NO: 952)

5'-AUGAAGUCAUAGGAAGAGGGCAUtt-3'      (SEQ ID NO: 233)
              3'-GUUACUUCAGUAUCCUUCUCCCGUAAA-5'    (SEQ ID NO: 593)
MET-3507 Target: 5'-CAATGAAGTCATAGGAAGAGGGCATTT-3' (SEQ ID NO: 953)

5'-UGAAGUCAUAGGAAGAGGGCAUUtt-3'      (SEQ ID NO: 234)
              3'-UUACUUCAGUAUCCUUCUCCCGUAAAA-5'    (SEQ ID NO: 594)
MET-3508 Target: 5'-AATGAAGTCATAGGAAGAGGGCATTTT-3' (SEQ ID NO: 954)

5'-GAAGUCAUAGGAAGAGGGCAUUUtg-3'      (SEQ ID NO: 235)
              3'-UACUUCAGUAUCCUUCUCCCGUAAAAC-5'    (SEQ ID NO: 595)
MET-3509 Target: 5'-ATGAAGTCATAGGAAGAGGGCATTTTG-3' (SEQ ID NO: 955)

5'-AAGUCAUAGGAAGAGGGCAUUUUgg-3'      (SEQ ID NO: 236)
              3'-ACUUCAGUAUCCUUCUCCCGUAAAACC-5'    (SEQ ID NO: 596)
MET-3510 Target: 5'-TGAAGTCATAGGAAGAGGGCATTTTGG-3' (SEQ ID NO: 956)

5'-AGUCAUAGGAAGAGGGCAUUUUGgt-3'      (SEQ ID NO: 237)
              3'-CUUCAGUAUCCUUCUCCCGUAAAACCA-5'    (SEQ ID NO: 597)
MET-3511 Target: 5'-GAAGTCATAGGAAGAGGGCATTTTGGT-3' (SEQ ID NO: 957)

5'-GUCAUAGGAAGAGGGCAUUUUGGtt-3'      (SEQ ID NO: 238)
              3'-UUCAGUAUCCUUCUCCCGUAAAACCAA-5'    (SEQ ID NO: 598)
MET-3512 Target: 5'-AAGTCATAGGAAGAGGGCATTTTGGTT-3' (SEQ ID NO: 958)
```

TABLE 2-continued

Selected Human Anti-MET DsiRNA Agents (Asymmetrics)

```
                 5'-UCAUAGGAAGAGGGCAUUUUGGUtg-3'      (SEQ ID NO: 239)
                 3'-UCAGUAUCCUUCUCCCGUAAAACCAAC-5'    (SEQ ID NO: 599)
MET-3513 Target: 5'-AGTCATAGGAAGAGGGCATTTTGGTTG-3'    (SEQ ID NO: 959)

5'-CAUAGGAAGAGGGCAUUUUGGUUgt-3'      (SEQ ID NO: 240)
                 3'-CAGUAUCCUUCUCCCGUAAAACCAACA-5'    (SEQ ID NO: 600)
MET-3514 Target: 5'-GTCATAGGAAGAGGGCATTTTGGTTGT-3'    (SEQ ID NO: 960)

5'-AUAGGAAGAGGGCAUUUUGGUUGtg-3'      (SEQ ID NO: 241)
                 3'-AGUAUCCUUCUCCCGUAAAACCAACAC-5'    (SEQ ID NO: 601)
MET-3515 Target: 5'-TCATAGGAAGAGGGCATTTTGGTTGTG-3'    (SEQ ID NO: 961)

5'-AAGAAAAUUCACUGUGCUGUGAAat-3'      (SEQ ID NO: 242)
                 3'-CGUUCUUUUAAGUGACACGACACUUUA-5'    (SEQ ID NO: 602)
MET-3572 Target: 5'-GCAAGAAAATTCACTGTGCTGTGAAAT-3'    (SEQ ID NO: 962)

5'-AGAAAAUUCACUGUGCUGUGAAAtc-3'      (SEQ ID NO: 243)
                 3'-GUUCUUUUAAGUGACACGACACUUUAG-5'    (SEQ ID NO: 603)
MET-3573 Target: 5'-CAAGAAAATTCACTGTGCTGTGAAATC-3'    (SEQ ID NO: 963)

5'-GAAAAUUCACUGUGCUGUGAAAUcc-3'      (SEQ ID NO: 244)
                 3'-UUCUUUUAAGUGACACGACACUUUAGG-5'    (SEQ ID NO: 604)
MET-3574 Target: 5'-AAGAAAATTCACTGTGCTGTGAAATCC-3'    (SEQ ID NO: 964)

5'-AAAAUUCACUGUGCUGUGAAAUCct-3'      (SEQ ID NO: 245)
                 3'-UCUUUUAAGUGACACGACACUUUAGGA-5'    (SEQ ID NO: 605)
MET-3575 Target: 5'-AGAAAATTCACTGTGCTGTGAAATCCT-3'    (SEQ ID NO: 965)

5'-AAAUUCACUGUGCUGUGAAAUCCtt-3'      (SEQ ID NO: 246)
                 3'-CUUUUAAGUGACACGACACUUUAGGAA-5'    (SEQ ID NO: 606)
MET-3576 Target: 5'-GAAAATTCACTGTGCTGTGAAATCCTT-3'    (SEQ ID NO: 966)

5'-AAUUCACUGUGCUGUGAAAUCCUtg-3'      (SEQ ID NO: 247)
                 3'-UUUUAAGUGACACGACACUUUAGGAAC-5'    (SEQ ID NO: 607)
MET-3577 Target: 5'-AAAATTCACTGTGCTGTGAAATCCTTG-3'    (SEQ ID NO: 967)

5'-AUUCACUGUGCUGUGAAAUCCUUga-3'      (SEQ ID NO: 248)
                 3'-UUUAAGUGACACGACACUUUAGGAACU-5'    (SEQ ID NO: 608)
MET-3578 Target: 5'-AAATTCACTGTGCTGTGAAATCCTTGA-3'    (SEQ ID NO: 968)

5'-UUCACUGUGCUGUGAAAUCCUUGaa-3'      (SEQ ID NO: 249)
                 3'-UUAAGUGACACGACACUUUAGGAACUU-5'    (SEQ ID NO: 609)
MET-3579 Target: 5'-AATTCACTGTGCTGTGAAATCCTTGAA-3'    (SEQ ID NO: 969)

5'-UCACUGUGCUGUGAAAUCCUUGAac-3'      (SEQ ID NO: 250)
                 3'-UAAGUGACACGACACUUUAGGAACUUG-5'    (SEQ ID NO: 610)
MET-3580 Target: 5'-ATTCACTGTGCTGTGAAATCCTTGAAC-3'    (SEQ ID NO: 970)

5'-CACUGUGCUGUGAAAUCCUUGAAca-3'      (SEQ ID NO: 251)
                 3'-AAGUGACACGACACUUUAGGAACUUGU-5'    (SEQ ID NO: 611)
MET-3581 Target: 5'-TTCACTGTGCTGTGAAATCCTTGAACA-3'    (SEQ ID NO: 971)

5'-ACUGUGCUGUGAAAUCCUUGAACag-3'      (SEQ ID NO: 252)
                 3'-AGUGACACGACACUUUAGGAACUUGUC-5'    (SEQ ID NO: 612)
MET-3582 Target: 5'-TCACTGTGCTGTGAAATCCTTGAACAG-3'    (SEQ ID NO: 972)

5'-GAGGGAAUCAUCAUGAAAGAUUUta-3'      (SEQ ID NO: 253)
                 3'-GGCUCCCUUAGUAGUACUUUCUAAAAU-5'    (SEQ ID NO: 613)
MET-3644 Target: 5'-CCGAGGGAATCATCATGAAAGATTTTA-3'    (SEQ ID NO: 973)

5'-AGGGAAUCAUCAUGAAAGAUUUUag-3'      (SEQ ID NO: 254)
                 3'-GCUCCCUUAGUAGUACUUUCUAAAAUC-5'    (SEQ ID NO: 614)
MET-3645 Target: 5'-CGAGGGAATCATCATGAAAGATTTTAG-3'   (SEQ ID NO: 974)

5'-GAGACUCAUAAUCCAACUGUAAAag-3'      (SEQ ID NO: 255)
                 3'-UACUCUGAGUAUUAGGUUGACAUUUUC-5'    (SEQ ID NO: 615)
MET-3779 Target: 5'-ATGAGACTCATAATCCAACTGTAAAAG-3'    (SEQ ID NO: 975)

5'-AGACUCAUAAUCCAACUGUAAAAga-3'      (SEQ ID NO: 256)
                 3'-ACUCUGAGUAUUAGGUUGACAUUUUCU-5'    (SEQ ID NO: 616)
MET-3780 Target: 5'-TGAGACTCATAATCCAACTGTAAAAGA-3'    (SEQ ID NO: 976)

5'-CUGUAAAAGAUCUUAUUGGCUUUgg-3'      (SEQ ID NO: 257)
                 3'-UUGACAUUUUCUAGAAUAACCGAAACC-5'    (SEQ ID NO: 617)
MET-3795 Target: 5'-AACTGTAAAAGATCTTATTGGCTTTGG-3'   (SEQ ID NO: 977)
```

TABLE 2-continued

Selected Human Anti-MET DsiRNA Agents (Asymmetrics)

|  |  |  |
| --- | --- | --- |
|  | 5'-GGCUUUGGUCUUCAAGUAGCCAAag-3' | (SEQ ID NO: 258) |
|  | 3'-AACCGAAACCAGAAGUUCAUCGGUUUUC-5' | (SEQ ID NO: 618) |
| MET-3812 Target: | 5'-TTGGCTTTGGTCTTCAAGTAGCCAAAG-3' | (SEQ ID NO: 978) |
|  | 5'-CUUCAAGUAGCCAAAGGCAUGAAat-3' | (SEQ ID NO: 259) |
|  | 3'-CAGAAGUUCAUCGGUUUCCGUACUUUA-5' | (SEQ ID NO: 619) |
| MET-3821 Target: | 5'-GTCTTCAAGTAGCCAAAGGCATGAAAT-3' | (SEQ ID NO: 979) |
|  | 5'-UUCAAGUAGCCAAAGGCAUGAAAta-3' | (SEQ ID NO: 260) |
|  | 3'-AGAAGUUCAUCGGUUUCCGUACUUUAU-5' | (SEQ ID NO: 620) |
| MET-3822 Target: | 5'-TCTTCAAGTAGCCAAAGGCATGAAATA-3' | (SEQ ID NO: 980) |
|  | 5'-UCAAGUAGCCAAAGGCAUGAAAUat-3' | (SEQ ID NO: 261) |
|  | 3'-GAAGUUCAUCGGUUUCCGUACUUUAUA-5' | (SEQ ID NO: 621) |
| MET-3823 Target: | 5'-CTTCAAGTAGCCAAAGGCATGAAATAT-3' | (SEQ ID NO: 981) |
|  | 5'-CAAGUAGCCAAAGGCAUGAAAUAtc-3' | (SEQ ID NO: 262) |
|  | 3'-AAGUUCAUCGGUUUCCGUACUUUAUAG-5' | (SEQ ID NO: 622) |
| MET-3824 Target: | 5'-TTCAAGTAGCCAAAGGCATGAAATATC-3' | (SEQ ID NO: 982) |
|  | 5'-AAGUAGCCAAAGGCAUGAAAUAUct-3' | (SEQ ID NO: 263) |
|  | 3'-AGUUCAUCGGUUUCCGUACUUUAUAGA-5' | (SEQ ID NO: 623) |
| MET-3825 Target: | 5'-TCAAGTAGCCAAAGGCATGAAATATCT-3' | (SEQ ID NO: 983) |
|  | 5'-AGUAGCCAAAGGCAUGAAAUAUCtt-3' | (SEQ ID NO: 264) |
|  | 3'-GUUCAUCGGUUUCCGUACUUUAUAGAA-5' | (SEQ ID NO: 624) |
| MET-3826 Target: | 5'-CAAGTAGCCAAAGGCATGAAATATCTT-3' | (SEQ ID NO: 984) |
|  | 5'-GUAGCCAAAGGCAUGAAAUAUCUtg-3' | (SEQ ID NO: 265) |
|  | 3'-UUCAUCGGUUUCCGUACUUUAUAGAAC-5' | (SEQ ID NO: 625) |
| MET-3827 Target: | 5'-AAGTAGCCAAAGGCATGAAATATCTTG-3' | (SEQ ID NO: 985) |
|  | 5'-UAGCCAAAGGCAUGAAAUAUCUUgc-3' | (SEQ ID NO: 266) |
|  | 3'-UCAUCGGUUUCCGUACUUUAUAGAACG-5' | (SEQ ID NO: 626) |
| MET-3828 Target: | 5'-AGTAGCCAAAGGCATGAAATATCTTGC-3' | (SEQ ID NO: 986) |
|  | 5'-AGCCAAAGGCAUGAAAUAUCUUGca-3' | (SEQ ID NO: 267) |
|  | 3'-CAUCGGUUUCCGUACUUUAUAGAACGU-5' | (SEQ ID NO: 627) |
| MET-3829 Target: | 5'-GTAGCCAAAGGCATGAAATATCTTGCA-3' | (SEQ ID NO: 987) |
|  | 5'-GCCAAAGGCAUGAAAUAUCUUGCaa-3' | (SEQ ID NO: 268) |
|  | 3'-AUCGGUUUCCGUACUUUAUAGAACGUU-5' | (SEQ ID NO: 628) |
| MET-3830 Target: | 5'-TAGCCAAAGGCATGAAATATCTTGCAA-3' | (SEQ ID NO: 988) |
|  | 5'-CCAAAGGCAUGAAAUAUCUUGCAag-3' | (SEQ ID NO: 269) |
|  | 3'-UCGGUUUCCGUACUUUAUAGAACGUUC-5' | (SEQ ID NO: 629) |
| MET-3831 Target: | 5'-AGCCAAAGGCATGAAATATCTTGCAAG-3' | (SEQ ID NO: 989) |
|  | 5'-CAAAGGCAUGAAAUAUCUUGCAAgc-3' | (SEQ ID NO: 270) |
|  | 3'-CGGUUUCCGUACUUUAUAGAACGUUCG-5' | (SEQ ID NO: 630) |
| MET-3832 Target: | 5'-GCCAAAGGCATGAAATATCTTGCAAGC-3' | (SEQ ID NO: 990) |
|  | 5'-AAAGGCAUGAAAUAUCUUGCAAGca-3' | (SEQ ID NO: 271) |
|  | 3'-GGUUUCCGUACUUUAUAGAACGUUCGU-5' | (SEQ ID NO: 631) |
| MET-3833 Target: | 5'-CCAAAGGCATGAAATATCTTGCAAGCA-3' | (SEQ ID NO: 991) |
|  | 5'-AAGGCAUGAAAUAUCUUGCAAGCaa-3' | (SEQ ID NO: 272) |
|  | 3'-GUUUCCGUACUUUAUAGAACGUUCGUU-5' | (SEQ ID NO: 632) |
| MET-3834 Target: | 5'-CAAAGGCATGAAATATCTTGCAAGCAA-3' | (SEQ ID NO: 992) |
|  | 5'-AGCAAAAGUUUGUCCACAGAGAct-3' | (SEQ ID NO: 273) |
|  | 3'-GUUCGUUUUCAAACAGGUGUCUCUGA-5' | (SEQ ID NO: 633) |
| MET-3854 Target: | 5'-CAAGCAAAAGTTTGTCCACAGAGACT-3' | (SEQ ID NO: 993) |
|  | 5'-GCAAAAGUUUGUCCACAGAGACtt-3' | (SEQ ID NO: 274) |
|  | 3'-UUCGUUUUCAAACAGGUGUCUCUGAA-5' | (SEQ ID NO: 634) |
| MET-3855 Target: | 5'-AAGCAAAAGTTTGTCCACAGAGACTT-3' | (SEQ ID NO: 994) |
|  | 5'-CAAAAGUUUGUCCACAGAGACUtg-3' | (SEQ ID NO: 275) |
|  | 3'-UCGUUUUCAAACAGGUGUCUCUGAAC-5' | (SEQ ID NO: 635) |
| MET-3856 Target: | 5'-AGCAAAAGTTTGTCCACAGAGACTTG-3' | (SEQ ID NO: 995) |
|  | 5'-AAAAGUUUGUCCACAGAGACUUgg-3' | (SEQ ID NO: 276) |
|  | 3'-CGUUUUCAAACAGGUGUCUCUGAACC-5' | (SEQ ID NO: 636) |
| MET-3857 Target: | 5'-GCAAAAGTTTGTCCACAGAGACTTGG-3' | (SEQ ID NO: 996) |

TABLE 2-continued

Selected Human Anti-MET DsiRNA Agents (Asymmetrics)

```
              5'-AAAAGUUUGUCCACAGAGACUUGgc-3'     (SEQ ID NO: 277)
              3'-GUUUUUCAAACAGGUGUCUCUGAACCG-5'   (SEQ ID NO: 637)
MET-3858 Target: 5'-CAAAAAGTTTGTCCACAGAGACTTGGC-3' (SEQ ID NO: 997)

5'-AAAGUUUGUCCACAGAGACUUGGct-3'    (SEQ ID NO: 278)
              3'-UUUUUCAAACAGGUGUCUCUGAACCGA-5'  (SEQ ID NO: 638)
MET-3859 Target: 5'-AAAAAGTTTGTCCACAGAGACTTGGCT-3' (SEQ ID NO: 998)

5'-AAGUUUGUCCACAGAGACUUGGCtg-3'    (SEQ ID NO: 279)
              3'-UUUUCAAACAGGUGUCUCUGAACCGAC-5'  (SEQ ID NO: 639)
MET-3860 Target: 5'-AAAAGTTTGTCCACAGAGACTTGGCTG-3' (SEQ ID NO: 999)

5'-AGUUUGUCCACAGAGACUUGGCUgc-3'    (SEQ ID NO: 280)
              3'-UUUCAAACAGGUGUCUCUGAACCGACG-5'  (SEQ ID NO: 640)
MET-3861 Target: 5'-AAAGTTTGTCCACAGAGACTTGGCTGC-3' (SEQ ID NO: 1000)

5'-CUUGGCUGCAAGAAACUGUAUGCtg-3'    (SEQ ID NO: 281)
              3'-CUGAACCGACGUUCUUUGACAUACGAC-5'  (SEQ ID NO: 641)
MET-3877 Target: 5'-GACTTGGCTGCAAGAAACTGTATGCTG-3' (SEQ ID NO: 1001)

5'-UGGCUGCAAGAAACUGUAUGCUGga-3'    (SEQ ID NO: 282)
              3'-GAACCGACGUUCUUUGACAUACGACCU-5'  (SEQ ID NO: 642)
MET-3879 Target: 5'-CTTGGCTGCAAGAAACTGTATGCTGGA-3' (SEQ ID NO: 1002)

5'-GGCUGCAAGAAACUGUAUGCUGGat-3'    (SEQ ID NO: 283)
              3'-AACCGACGUUCUUUGACAUACGACCUA-5'  (SEQ ID NO: 643)
MET-3880 Target: 5'-TTGGCTGCAAGAAACTGTATGCTGGAT-3' (SEQ ID NO: 1003)

5'-GCUGCAAGAAACUGUAUGCUGGAtg-3'    (SEQ ID NO: 284)
              3'-ACCGACGUUCUUUGACAUACGACCUAC-5'  (SEQ ID NO: 644)
MET-3881 Target: 5'-TGGCTGCAAGAAACTGTATGCTGGATG-3' (SEQ ID NO: 1004)

5'-CUGCAAGAAACUGUAUGCUGGAUga-3'    (SEQ ID NO: 285)
              3'-CCGACGUUCUUUGACAUACGACCUACU-5'  (SEQ ID NO: 645)
MET-3882 Target: 5'-GGCTGCAAGAAACTGTATGCTGGATGA-3' (SEQ ID NO: 1005)

5'-GUCAAGGUUGCUGAUUUUGGUCUtg-3'    (SEQ ID NO: 286)
              3'-GUCAGUUCCAACGACUAAAACCAGAAC-5'  (SEQ ID NO: 646)
MET-3917 Target: 5'-CAGTCAAGGTTGCTGATTTTGGTCTTG-3' (SEQ ID NO: 1006)

5'-GGUUGCUGAUUUUGGUCUUGCCAga-3'    (SEQ ID NO: 287)
              3'-UUCCAACGACUAAAACCAGAACGGUCU-5'  (SEQ ID NO: 647)
MET-3922 Target: 5'-AAGGTTGCTGATTTTGGTCTTGCCAGA-3' (SEQ ID NO: 1007)

5'-UUGCUGAUUUUGGUCUUGCCAGAga-3'    (SEQ ID NO: 288)
              3'-CCAACGACUAAAACCAGAACGGUCUCU-5'  (SEQ ID NO: 648)
MET-3924 Target: 5'-GGTTGCTGATTTTGGTCTTGCCAGAGA-3' (SEQ ID NO: 1008)

5'-GGUCUUGCCAGAGACAUGUAUGAta-3'    (SEQ ID NO: 289)
              3'-AACCAGAACGGUCUCUGUACAUACUAU-5'  (SEQ ID NO: 649)
MET-3935 Target: 5'-TTGGTCTTGCCAGAGACATGTATGATA-3' (SEQ ID NO: 1009)

5'-GUCUUGCCAGAGACAUGUAUGAUaa-3'    (SEQ ID NO: 290)
              3'-ACCAGAACGGUCUCUGUACAUACUAUU-5'  (SEQ ID NO: 650)
MET-3936 Target: 5'-TGGTCTTGCCAGAGACATGTATGATAA-3' (SEQ ID NO: 1010)

5'-GCUGCCAGUGAAGUGGAUGGCUUtg-3'    (SEQ ID NO: 291)
              3'-UUCGACGGUCACUUCACCUACCGAAAC-5'  (SEQ ID NO: 651)
MET-3997 Target: 5'-AAGCTGCCAGTGAAGTGGATGGCTTTG-3' (SEQ ID NO: 1011)

5'-CUGCCAGUGAAGUGGAUGGCUUUgg-3'    (SEQ ID NO: 292)
              3'-UCGACGGUCACUUCACCUACCGAAACC-5'  (SEQ ID NO: 652)
MET-3998 Target: 5'-AGCTGCCAGTGAAGTGGATGGCTTTGG-3' (SEQ ID NO: 1012)

5'-GUGGAUGGCUUUGGAAAGUCUGCaa-3'    (SEQ ID NO: 293)
              3'-UUCACCUACCGAAACCUUUCAGACGUU-5'  (SEQ ID NO: 653)
MET-4009 Target: 5'-AAGTGGATGGCTTTGGAAAGTCTGCAA-3' (SEQ ID NO: 1013)

5'-GGAUGGCUUUGGAAAGUCUGCAAac-3'    (SEQ ID NO: 294)
              3'-CACCUACCGAAACCUUUCAGACGUUUG-5'  (SEQ ID NO: 654)
MET-4011 Target: 5'-GTGGATGGCTTTGGAAAGTCTGCAAAC-3' (SEQ ID NO: 1014)

5'-UUUGGAAAGUCUGCAAACUCAAAg-3'     (SEQ ID NO: 295)
              3'-CGAAACCUUUCAGACGUUUGAGUUUUC-5'  (SEQ ID NO: 655)
MET-4018 Target: 5'-GCTTTGGAAAGTCTGCAAACTCAAAAG-3' (SEQ ID NO: 1015)
```

TABLE 2-continued

Selected Human Anti-MET DsiRNA Agents (Asymmetrics)

```
                5'-CUUUGGCGUGCUCCUCUGGGAGCtg-3'   (SEQ ID NO: 296)
                3'-AGGAAACCGCACGAGGAGACCCUCGAC-5'  (SEQ ID NO: 656)
MET-4069 Target: 5'-TCCTTTGGCGTGCTCCTCTGGGAGCTG-3' (SEQ ID NO: 1016)

5'-UUGGCGUGCUCCUCUGGGAGCUGat-3'   (SEQ ID NO: 297)
                3'-GAAACCGCACGAGGAGACCCUCGACUA-5'  (SEQ ID NO: 657)
MET-4071 Target: 5'-CTTTGGCGTGCTCCTCTGGGAGCTGAT-3' (SEQ ID NO: 1017)

5'-UGGCGUGCUCCUCUGGGAGCUGAtg-3'   (SEQ ID NO: 298)
                3'-AAACCGCACGAGGAGACCCUCGACUAC-5'  (SEQ ID NO: 658)
MET-4072 Target: 5'-TTTGGCGTGCTCCTCTGGGAGCTGATG-3' (SEQ ID NO: 1018)

5'-GGCGUGCUCCUCUGGGAGCUGAUga-3'   (SEQ ID NO: 299)
                3'-AACCGCACGAGGAGACCCUCGACUACU-5'  (SEQ ID NO: 659)
MET-4073 Target: 5'-TTGGCGTGCTCCTCTGGGAGCTGATGA-3' (SEQ ID NO: 1019)

5'-GCGUGCUCCUCUGGGAGCUGAUGac-3'   (SEQ ID NO: 300)
                3'-ACCGCACGAGGAGACCCUCGACUACUG-5'  (SEQ ID NO: 660)
MET-4074 Target: 5'-TGGCGTGCTCCTCTGGGAGCTGATGAC-3' (SEQ ID NO: 1020)

5'-GUGAACGCUACUUAUGUGAACGUaa-3'   (SEQ ID NO: 301)
                3'-UACACUUGCGAUGAAUACACUUGCAUU-5'  (SEQ ID NO: 661)
MET-4319 Target: 5'-ATGTGAACGCTACTTATGTGAACGTAA-3' (SEQ ID NO: 1021)

5'-UGAACGCUACUUAUGUGAACGUAaa-3'   (SEQ ID NO: 302)
                3'-ACACUUGCGAUGAAUACACUUGCAUUU-5'  (SEQ ID NO: 662)
MET-4320 Target: 5'-TGTGAACGCTACTTATGTGAACGTAAA-3' (SEQ ID NO: 1022)

5'-CUGUUGUCAUCAGAAGAUAACGCtg-3'   (SEQ ID NO: 303)
                3'-GAGACAACAGUAGUCUUCUAUUGCGAC-5'  (SEQ ID NO: 663)
MET-4367 Target: 5'-CTCTGTTGTCATCAGAAGATAACGCTG-3' (SEQ ID NO: 1023)

5'-UUGCUCUUGCCAAAAUUGCACUAtt-3'   (SEQ ID NO: 304)
                3'-GAAACGAGAACGGUUUUAACGUGAUAA-5'  (SEQ ID NO: 664)
MET-4523 Target: 5'-CTTTGCTCTTGCCAAAATTGCACTATT-3' (SEQ ID NO: 1024)

5'-AUUGUUAUUUAAAUUACUGGAUUct-3'   (SEQ ID NO: 305)
                3'-CAUAACAAUAAAUUUAAUGACCUAAGA-5'  (SEQ ID NO: 665)
MET-4559 Target: 5'-GTATTGTTATTTAAATTACTGGATTCT-3' (SEQ ID NO: 1025)

5'-CUGGAUUCUAAGGAAUUUCUUAUct-3'   (SEQ ID NO: 306)
                3'-AUGACCUAAGAUUCCUUAAAGAAUAGA-5'  (SEQ ID NO: 666)
MET-4575 Target: 5'-TACTGGATTCTAAGGAATTTCTTATCT-3' (SEQ ID NO: 1026)

5'-UGGAUUCUAAGGAAUUUCUUAUCtg-3'   (SEQ ID NO: 307)
                3'-UGACCUAAGAUUCCUUAAAGAAUAGAC-5'  (SEQ ID NO: 667)
MET-4576 Target: 5'-ACTGGATTCTAAGGAATTTCTTATCTG-3' (SEQ ID NO: 1027)

5'-GGUUGAAUUUUUUAAAAAUCAGGta-3'   (SEQ ID NO: 308)
                3'-ACCCAACUUAAAAAAUUUUUAGUCCAU-5'  (SEQ ID NO: 668)
MET-4703 Target: 5'-TGGGTTGAATTTTTTAAAAATCAGGTA-3' (SEQ ID NO: 1028)

5'-AAACAUUCCCUUUUAAAUGUUUGtt-3'   (SEQ ID NO: 309)
                3'-CAUUUGUAAGGGAAAAUUUACAAACAA-5'  (SEQ ID NO: 669)
MET-4935 Target: 5'-GTAAACATTCCCTTTTAAATGTTTGTT-3' (SEQ ID NO: 1029)

5'-UUAAAUGUUUGUUUGUUUUUUGAga-3'   (SEQ ID NO: 310)
                3'-AAAAUUUACAAACAAACAAAAAACUCU-5'  (SEQ ID NO: 670)
MET-4947 Target: 5'-TTTTAAATGTTTGTTTGTTTTTGAGA-3'  (SEQ ID NO: 1030)

5'-GGAUCUCACUCUGUUGCCAGGGCtg-3'   (SEQ ID NO: 311)
                3'-GUCCUAGAGUGAGACAACGGUCCCGAC-5'  (SEQ ID NO: 671)
MET-4974 Target: 5'-CAGGATCTCACTCTGTTGCCAGGGCTG-3' (SEQ ID NO: 1031)

5'-AUCUCACUCUGUUGCCAGGGCUGta-3'   (SEQ ID NO: 312)
                3'-CCUAGAGUGAGACAACGGUCCCGACAU-5'  (SEQ ID NO: 672)
MET-4976 Target: 5'-GGATCTCACTCTGTTGCCAGGGCTGTA-3' (SEQ ID NO: 1032)

5'-CACUCUGUUGCCAGGGCUGUAGUgc-3'   (SEQ ID NO: 313)
                3'-GAGUGAGACAACGGUCCCGACAUCACG-5'  (SEQ ID NO: 673)
MET-4980 Target: 5'-CTCACTCTGTTGCCAGGGCTGTAGTGC-3' (SEQ ID NO: 1033)

5'-CUCUGUUGCCAGGGCUGUAGUGCag-3'   (SEQ ID NO: 314)
                3'-GUGAGACAACGGUCCCGACAUCACGUC-5'  (SEQ ID NO: 674)
MET-4982 Target: 5'-CACTCTGTTGCCAGGGCTGTAGTGCAG-3' (SEQ ID NO: 1034)
```

TABLE 2-continued

Selected Human Anti-MET DsiRNA Agents (Asymmetrics)

```
              5'-GUUGCCAGGGCUGUAGUGCAGUGgt-3'      (SEQ ID NO: 315)
              3'-GACAACGGUCCCGACAUCACGUCACCA-5'    (SEQ ID NO: 675)
MET-4986 Target: 5'-CTGTTGCCAGGGCTGTAGTGCAGTGGT-3' (SEQ ID NO: 1035)

5'-CUGUAGUGCAGUGGUGUGAUCAUag-3'     (SEQ ID NO: 316)
              3'-CCGACAUCACGUCACCACACUAGUAUC-5'   (SEQ ID NO: 676)
MET-4996 Target: 5'-GGCTGTAGTGCAGTGGTGTGATCATAG-3' (SEQ ID NO: 1036)

5'-GCAGUGGUGUGAUCAUAGCUCACtg-3'     (SEQ ID NO: 317)
              3'-CACGUCACCACACUAGUAUCGAGUGAC-5'   (SEQ ID NO: 677)
MET-5003 Target: 5'-GTGCAGTGGTGTGATCATAGCTCACTG-3' (SEQ ID NO: 1037)

5'-GGCUAAUUUUUGUAUUUUUUGUAga-3'     (SEQ ID NO: 318)
              3'-GGCCGAUUAAAAACAUAAAAAACAUCU-5'   (SEQ ID NO: 678)
MET-5094 Target: 5'-CCGGCTAATTTTTGTATTTTTTGTAGA-3' (SEQ ID NO: 1038)

5'-UUAUAAAUUUUGUAUAGACAUUcc-3'      (SEQ ID NO: 319)
              3'-GGAAUAUUUAAAAACAUAUCUGUAAGG-5'   (SEQ ID NO: 679)
MET-5234 Target: 5'-CCTTATAAATTTTGTATAGACATTCC-3'  (SEQ ID NO: 1039)

5'-UGGAAGAAUAUUUAUAGGCAAUAca-3'     (SEQ ID NO: 320)
              3'-CAACCUUCUUAUAAAUAUCCGUUAUGU-5'   (SEQ ID NO: 680)
MET-5265 Target: 5'-GTTGGAAGAATATTTATAGGCAATACA-3' (SEQ ID NO: 1040)

5'-CACAAAACAUGUUUAUAAAUGAAca-3'     (SEQ ID NO: 321)
              3'-GUGUGUUUUGUACAAAUAUUUACUUGU-5'   (SEQ ID NO: 681)
MET-5313 Target: 5'-CACACAAAACATGTTTATAAATGAACA-3' (SEQ ID NO: 1041)

5'-GACAUUAAGAAAAUUUGUAUGAAat-3'     (SEQ ID NO: 322)
              3'-UACUGUAAUUCUUUUAAACAUACUUUA-5'   (SEQ ID NO: 682)
MET-5357 Target: 5'-ATGACATTAAGAAAATTTGTATGAAAT-3' (SEQ ID NO: 1042)

5'-GUGUGUAUUUUUUAAAUGAAAct-3'       (SEQ ID NO: 323)
              3'-AACACACAUAAAAAAAUUUACUUUUGA-5'   (SEQ ID NO: 683)
MET-5479 Target: 5'-TTGTGTGTATTTTTTAAATGAAACT-3'   (SEQ ID NO: 1043)

5'-CUCAGCAUGUUUGUAAAGCAGGAta-3'     (SEQ ID NO: 324)
              3'-UUGAGUCGUACAAACAUUUCGUCCUAU-5'   (SEQ ID NO: 684)
MET-5548 Target: 5'-AACTCAGCATGTTTGTAAAGCAGGATA-3' (SEQ ID NO: 1044)

5'-GAUGGAUUGAAAAGAUUAGCCUCtg-3'     (SEQ ID NO: 325)
              3'-ACCUACCUAACUUUUCUAAUCGGAGAC-5'   (SEQ ID NO: 685)
MET-5634 Target: 5'-TGGATGGATTGAAAAGATTAGCCTCTG-3' (SEQ ID NO: 1045)

5'-UCUGUGGAAUUUUGUGCUUGCUAct-3'     (SEQ ID NO: 326)
              3'-UAAGACACCUUAAAACACGAACGAUGA-5'   (SEQ ID NO: 686)
MET-5847 Target: 5'-ATTCTGTGGAATTTTGTGCTTGCTACT-3' (SEQ ID NO: 1046)

5'-CUGUGGAAUUUUGUGCUUGCUACtg-3'     (SEQ ID NO: 327)
              3'-AAGACACCUUAAAACACGAACGAUGAC-5'   (SEQ ID NO: 687)
MET-5848 Target: 5'-TTCTGTGGAATTTTGTGCTTGCTACTG-3' (SEQ ID NO: 1047)

5'-GUGGAAUUUUGUGCUUGCUACUGta-3'     (SEQ ID NO: 328)
              3'-GACACCUUAAAACACGAACGAUGACAU-5'   (SEQ ID NO: 688)
MET-5850 Target: 5'-CTGTGGAATTTTGTGCTTGCTACTGTA-3' (SEQ ID NO: 1048)

5'-GAAUUUUGUGCUUGCUACUGUAUag-3'     (SEQ ID NO: 329)
              3'-ACCUUAAAACACGAACGAUGACAUAUC-5'   (SEQ ID NO: 689)
MET-5853 Target: 5'-TGGAATTTTGTGCTTGCTACTGTATAG-3' (SEQ ID NO: 1049)

5'-UUUUGUGCUUGCUACUGUAUAGUgc-3'     (SEQ ID NO: 330)
              3'-UUAAAACACGAACGAUGACAUAUCACG-5'   (SEQ ID NO: 690)
MET-5856 Target: 5'-AATTTTGTGCTTGCTACTGTATAGTGC-3' (SEQ ID NO: 1050)

5'-UUGUGCUUGCUACUGUAUAGUGCat-3'     (SEQ ID NO: 331)
              3'-AAAACACGAACGAUGACAUAUCACGUA-5'   (SEQ ID NO: 691)
MET-5858 Target: 5'-TTTTGTGCTTGCTACTGTATAGTGCAT-3' (SEQ ID NO: 1051)

5'-UGUGCUUGCUACUGUAUAGUGCAtg-3'     (SEQ ID NO: 332)
              3'-AAACACGAACGAUGACAUAUCACGUAC-5'   (SEQ ID NO: 692)
MET-5859 Target: 5'-TTTGTGCTTGCTACTGTATAGTGCATG-3' (SEQ ID NO: 1052)

5'-GUGCUUGCUACUGUAUAGUGCAUgt-3'     (SEQ ID NO: 333)
              3'-AACACGAACGAUGACAUAUCACGUACA-5'   (SEQ ID NO: 693)
MET-5860 Target: 5'-TTGTGCTTGCTACTGTATAGTGCATGT-3' (SEQ ID NO: 1053)
```

TABLE 2-continued

Selected Human Anti-MET DsiRNA Agents (Asymmetrics)

```
                5'-UGCUUGCUACUGUAUAGUGCAUGtg-3'      (SEQ ID NO: 334)
                3'-ACACGAACGAUGACAUAUCACGUACAC-5'    (SEQ ID NO: 694)
MET-5861 Target: 5'-TGTGCTTGCTACTGTATAGTGCATGTG-3'   (SEQ ID NO: 1054)

5'-GCUUGCUACUGUAUAGUGCAUGUgg-3'      (SEQ ID NO: 335)
                3'-CACGAACGAUGACAUAUCACGUACACC-5'    (SEQ ID NO: 695)
MET-5862 Target: 5'-GTGCTTGCTACTGTATAGTGCATGTGG-3'   (SEQ ID NO: 1055)

5'-UUGCUACUGUAUAGUGCAUGUGGtg-3'      (SEQ ID NO: 336)
                3'-CGAACGAUGACAUAUCACGUACACCAC-5'    (SEQ ID NO: 696)
MET-5864 Target: 5'-GCTTGCTACTGTATAGTGCATGTGGTG-3'   (SEQ ID NO: 1056)

5'-GCUACUGUAUAGUGCAUGUGGGUta-3'      (SEQ ID NO: 337)
                3'-AACGAUGACAUAUCACGUACACCACAU-5'    (SEQ ID NO: 697)
MET-5866 Target: 5'-TTGCTACTGTATAGTGCATGTGGTGTA-3'   (SEQ ID NO: 1057)

5'-CUACUGUAUAGUGCAUGUGGGUGUag-3'     (SEQ ID NO: 338)
                3'-ACGAUGACAUAUCACGUACACCACAUC-5'    (SEQ ID NO: 698)
MET-5867 Target: 5'-TGCTACTGTATAGTGCATGTGGTGTAG-3'   (SEQ ID NO: 1058)

5'-UACUGUAUAGUGCAUGUGGGUGUAgg-3'     (SEQ ID NO: 339)
                3'-CGAUGACAUAUCACGUACACCACAUCC-5'    (SEQ ID NO: 699)
MET-5868 Target: 5'-GCTACTGTATAGTGCATGTGGTGTAGG-3'   (SEQ ID NO: 1059)

5'-AACAUUUAAAGUGUUAUAUUUUUta-3'      (SEQ ID NO: 340)
                3'-AUUUGUAAAUUUCACAAUAUAAAAAAU-5'    (SEQ ID NO: 700)
MET-5919 Target: 5'-TAAACATTTAAAGTGTTATATTTTTA-3'    (SEQ ID NO: 1060)

5'-AAAAUGUUUAUUUUUAAUGAUAUga-3'      (SEQ ID NO: 341)
                3'-AUUUUUACAAAUAAAAAUUACUAUACU-5'    (SEQ ID NO: 701)
MET-5946 Target: 5'-TAAAAATGTTTATTTTTAATGATATGA-3'   (SEQ ID NO: 1061)

5'-AAAUGUUUAUUUUUAAUGAUAUGag-3'      (SEQ ID NO: 342)
                3'-UUUUUACAAAUAAAAAUUACUAUACUC-5'    (SEQ ID NO: 702)
MET-5947 Target: 5'-AAAAATGTTTATTTTTAATGATATGAG-3'   (SEQ ID NO: 1062)

5'-AAUGUUUAUUUUUAAUGAUAUGAga-3'      (SEQ ID NO: 343)
                3'-UUUUACAAAUAAAAAUUACUAUACUCU-5'    (SEQ ID NO: 703)
MET-5948 Target: 5'-AAAATGTTTATTTTTAATGATATGAGA-3'   (SEQ ID NO: 1063)

5'-ACUGUGAACAUUUUAGAAAAGGUat-3'      (SEQ ID NO: 344)
                3'-CGUGACACUUGUAAAAUCUUUUCCAUA-5'    (SEQ ID NO: 704)
MET-6002 Target: 5'-GCACTGTGAACATTTTAGAAAAGGTAT-3'   (SEQ ID NO: 1064)

5'-GAUAAGGAAAUGUACUGAUUGCCaa-3'      (SEQ ID NO: 345)
                3'-CGCUAUUCCUUUACAUGACUAACGGUU-5'    (SEQ ID NO: 705)
MET-6075 Target: 5'-GCGATAAGGAAATGTACTGATTGCCAA-3'   (SEQ ID NO: 1065)

5'-AUAAGGAAAUGUACUGAUUGCCAat-3'      (SEQ ID NO: 346)
                3'-GCUAUUCCUUUACAUGACUAACGGUUA-5'    (SEQ ID NO: 706)
MET-6076 Target: 5'-CGATAAGGAAATGTACTGATTGCCAAT-3'   (SEQ ID NO: 1066)

5'-UAAGGAAAUGUACUGAUUGCCAAta-3'      (SEQ ID NO: 347)
                3'-CUAUUCCUUUACAUGACUAACGGUUAU-5'    (SEQ ID NO: 707)
MET-6077 Target: 5'-GATAAGGAAATGTACTGATTGCCAATA-3'   (SEQ ID NO: 1067)

5'-AAGGAAAUGUACUGAUUGCCAAUac-3'      (SEQ ID NO: 348)
                3'-UAUUCCUUUACAUGACUAACGGUUAUG-5'    (SEQ ID NO: 708)
MET-6078 Target: 5'-ATAAGGAAATGTACTGATTGCCAATAC-3'   (SEQ ID NO: 1068)

5'-AGGAAAUGUACUGAUUGCCAAUAca-3'      (SEQ ID NO: 349)
                3'-AUUCCUUUACAUGACUAACGGUUAUGU-5'    (SEQ ID NO: 709)
MET-6079 Target: 5'-TAAGGAAATGTACTGATTGCCAATACA-3'   (SEQ ID NO: 1069)

5'-GGAAAUGUACUGAUUGCCAAUACac-3'      (SEQ ID NO: 350)
                3'-UUCCUUUACAUGACUAACGGUUAUGUG-5'    (SEQ ID NO: 710)
MET-6080 Target: 5'-AAGGAAATGTACTGATTGCCAATACAC-3'   (SEQ ID NO: 1070)

5'-CAGGACUUGAAGCCAAGGGUUAAcc-3'      (SEQ ID NO: 351)
                3'-UAGUCCUGAACUUCGGUUCCCAAUUGG-5'    (SEQ ID NO: 711)
MET-6124 Target: 5'-ATCAGGACTTGAAGCCAAGGGTTAACC-3'   (SEQ ID NO: 1071)

5'-AGGACUUGAAGCCAAGGGUUAACcc-3'      (SEQ ID NO: 352)
                3'-AGUCCUGAACUUCGGUUCCCAAUUGGG-5'    (SEQ ID NO: 712)
MET-6125 Target: 5'-TCAGGACTTGAAGCCAAGGGTTAACCC-3'   (SEQ ID NO: 1072)
```

TABLE 2-continued

Selected Human Anti-MET DsiRNA Agents (Asymmetrics)

```
                5'-GGACUUGAAGCCAAGGGUUAACCca-3'   (SEQ ID NO: 353)
                3'-GUCCUGAACUUCGGUUCCCAAUUGGGU-5' (SEQ ID NO: 713)
MET-6126 Target: 5'-CAGGACTTGAAGCCAAGGGTTAACCCA-3'  (SEQ ID NO: 1073)

5'-GACUUGAAGCCAAGGGUUAACCCag-3'   (SEQ ID NO: 354)
                3'-UCCUGAACUUCGGUUCCCAAUUGGGUC-5' (SEQ ID NO: 714)
MET-6127 Target: 5'-AGGACTTGAAGCCAAGGGTTAACCCAG-3'  (SEQ ID NO: 1074)

5'-ACUUGAAGCCAAGGGUUAACCCAgc-3'   (SEQ ID NO: 355)
                3'-CCUGAACUUCGGUUCCCAAUUGGGUCG-5' (SEQ ID NO: 715)
MET-6128 Target: 5'-GGACTTGAAGCCAAGGGTTAACCCAGC-3'  (SEQ ID NO: 1075)

5'-CCGUUUCAUAAAUGUAAUAAGUAat-3'   (SEQ ID NO: 356)
                3'-ACGGCAAAGUAUUUACAUUAUUCAUUA-5' (SEQ ID NO: 716)
MET-6307 Target: 5'-TGCCGTTTCATAAATGTAATAAGTAAT-3'  (SEQ ID NO: 1076)

5'-UGCUAUUUAUAAACUUGUCCUUAga-3'   (SEQ ID NO: 357)
                3'-AAACGAUAAAUAUUUGAACAGGAAUCU-5' (SEQ ID NO: 717)
MET-6520 Target: 5'-TTTGCTATTTATAAACTTGTCCTTAGA-3'  (SEQ ID NO: 1077)

5'-UUGUCACUGCCUAUACCUGCAGCtg-3'   (SEQ ID NO: 358)
                3'-UGAACAGUGACGGAUAUGGACGUCGAC-5' (SEQ ID NO: 718)
MET-6599 Target: 5'-ACTTGTCACTGCCTATACCTGCAGCTG-3'  (SEQ ID NO: 1078)

5'-UGUCACUGCCUAUACCUGCAGCUga-3'   (SEQ ID NO: 359)
                3'-GAACAGUGACGGAUAUGGACGUCGACU-5' (SEQ ID NO: 719)
MET-6600 Target: 5'-CTTGTCACTGCCTATACCTGCAGCTGA-3'  (SEQ ID NO: 1079)

5'-GUCACUGCCUAUACCUGCAGCUGaa-3'   (SEQ ID NO: 360)
                3'-AACAGUGACGGAUAUGGACGUCGACUU-5' (SEQ ID NO: 720)
MET-6601 Target: 5'-TTGTCACTGCCTATACCTGCAGCTGAA-3'  (SEQ ID NO: 1080)
```

TABLE 3

Selected Human Anti-MET DsiRNAs, Unmodified Duplexes (Asymmetrics)

```
                5'-CGCGGAGCGCGCGUGUGGUCCUUGC-3'   (SEQ ID NO: 1081)
                3'-CCGCGCCUCGCGCGCACACCAGGAACG-5' (SEQ ID NO: 361)
MET-136 Target: 5'-GGCGCGGAGCGCGCGTGTGGTCCTTGC-3'  (SEQ ID NO: 721)

5'-GCGGAGCGCGCGUGUGGUCCUUGCG-3'   (SEQ ID NO: 1082)
                3'-CGCGCCUCGCGCGCACACCAGGAACGC-5' (SEQ ID NO: 362)
MET-137 Target: 5'-GCGCGGAGCGCGCGTGTGGTCCTTGCG-3'  (SEQ ID NO: 722)

5'-CGGAGCGCGCGUGUGGUCCUUGCGC-3'   (SEQ ID NO: 1083)
                3'-GCGCCUCGCGCGCACACCAGGAACGCG-5' (SEQ ID NO: 363)
MET-138 Target: 5'-CGCGGAGCGCGCGTGTGGTCCTTGCGC-3'  (SEQ ID NO: 723)

5'-GAGCGCGCGUGUGGUCCUUGCGCCG-3'   (SEQ ID NO: 1084)
                3'-GCCUCGCGCGCACACCAGGAACGCGGC-5' (SEQ ID NO: 364)
MET-140 Target: 5'-CGGAGCGCGCGTGTGGTCCTTGCGCCG-3'  (SEQ ID NO: 724)

5'-GCGCGCGUGUGGUCCUUGCGCCGCU-3'   (SEQ ID NO: 1085)
                3'-CUCGCGCGCACACCAGGAACGCGGCGA-5' (SEQ ID NO: 365)
MET-142 Target: 5'-GAGCGCGCGTGTGGTCCTTGCGCCGCT-3'  (SEQ ID NO: 725)

5'-CGCGCGUGUGGUCCUUGCGCCGCUG-3'   (SEQ ID NO: 1086)
                3'-UCGCGCGCACACCAGGAACGCGGCGAC-5' (SEQ ID NO: 366)
MET-143 Target: 5'-AGCGCGCGTGTGGTCCTTGCGCCGCTG-3'  (SEQ ID NO: 726)

5'-CGCGUGUGGUCCUUGCGCCGCUGAC-3'   (SEQ ID NO: 1087)
                3'-GCGCGCACACCAGGAACGCGGCGACUG-5' (SEQ ID NO: 367)
MET-145 Target: 5'-CGCGCGTGTGGTCCTTGCGCCGCTGAC-3'  (SEQ ID NO: 727)

5'-GCGUGUGGUCCUUGCGCCGCUGACU-3'   (SEQ ID NO: 1088)
                3'-CGCGCACACCAGGAACGCGGCGACUGA-5' (SEQ ID NO: 368)
MET-146 Target: 5'-GCGCGTGTGGTCCTTGCGCCGCTGACT-3'  (SEQ ID NO: 728)

5'-GUGUGGUCCUUGCGCCGCUGACUUC-3'   (SEQ ID NO: 1089)
                3'-CGCACACCAGGAACGCGGCGACUGAAG-5' (SEQ ID NO: 369)
MET-148 Target: 5'-GCGTGTGGTCCTTGCGCCGCTGACTTC-3'  (SEQ ID NO: 729)
```

TABLE 3-continued

Selected Human Anti-MET DsiRNAs, Unmodified Duplexes (Asymmetrics)

```
                5'-CCUUGCGCCGCUGACUUCUCCACUG-3'   (SEQ ID NO: 1090)
                3'-CAGGAACGCGGCGACUGAAGAGGUGAC-5'  (SEQ ID NO: 370)
MET-155 Target: 5'-GTCCTTGCGCCGCTGACTTCTCCACTG-3'  (SEQ ID NO: 730)

5'-GCGCCGCUGACUUCUCCACUGGUUC-3'   (SEQ ID NO: 1091)
                3'-AACGCGGCGACUGAAGAGGUGACCAAG-5'  (SEQ ID NO: 371)
MET-159 Target: 5'-TTGCGCCGCTGACTTCTCCACTGGTTC-3'  (SEQ ID NO: 731)

5'-CUGUGCUUGCACCUGGCAUCCUCGU-3'   (SEQ ID NO: 1092)
                3'-GCGACACGAACGUGGACCGUAGGAGCA-5'  (SEQ ID NO: 372)
MET-225 Target: 5'-CGCTGTGCTTGCACCTGGCATCCTCGT-3'  (SEQ ID NO: 732)

5'-GUGCUUGCACCUGGCAUCCUCGUGC-3'   (SEQ ID NO: 1093)
                3'-GACACGAACGUGGACCGUAGGAGCACG-5'  (SEQ ID NO: 373)
MET-227 Target: 5'-CTGTGCTTGCACCTGGCATCCTCGTGC-3'  (SEQ ID NO: 733)

5'-CACCUGGCAUCCUCGUGCUCCUGUU-3'   (SEQ ID NO: 1094)
                3'-ACGUGGACCGUAGGAGCACGAGGACAA-5'  (SEQ ID NO: 374)
MET-234 Target: 5'-TGCACCTGGCATCCTCGTGCTCCTGTT-3'  (SEQ ID NO: 734)

5'-CUCGUGCUCCUGUUUACCUUGGUGC-3'   (SEQ ID NO: 1095)
                3'-AGGAGCACGAGGACAAAUGGAACCACG-5'  (SEQ ID NO: 375)
MET-245 Target: 5'-TCCTCGTGCTCCTGTTTACCTTGGTGC-3'  (SEQ ID NO: 735)

5'-GUGCUCCUGUUUACCUUGGUGCAGA-3'   (SEQ ID NO: 1096)
                3'-AGCACGAGGACAAAUGGAACCACGUCU-5'  (SEQ ID NO: 376)
MET-248 Target: 5'-TCGTGCTCCTGTTTACCTTGGTGCAGA-3'  (SEQ ID NO: 736)

5'-UGCUCCUGUUUACCUUGGUGCAGAG-3'   (SEQ ID NO: 1097)
                3'-GCACGAGGACAAAUGGAACCACGUCUC-5'  (SEQ ID NO: 377)
MET-249 Target: 5'-CGTGCTCCTGTTTACCTTGGTGCAGAG-3'  (SEQ ID NO: 737)

5'-CACUAACUACAUUUAUGUUUUAAAU-3'   (SEQ ID NO: 1098)
                3'-CGGUGAUUGAUGUAAAUACAAAAUUUA-5'  (SEQ ID NO: 378)
MET-409 Target: 5'-GCCACTAACTACATTTATGTTTTAAAT-3'  (SEQ ID NO: 738)

5'-AACUACAUUUAUGUUUUAAAUGAGG-3'   (SEQ ID NO: 1099)
                3'-GAUUGAUGUAAAUACAAAAUUUACUCC-5'  (SEQ ID NO: 379)
MET-413 Target: 5'-CTAACTACATTTATGTTTTAAATGAGG-3'  (SEQ ID NO: 739)

5'-ACUACAUUUAUGUUUUAAAUGAGGA-3'   (SEQ ID NO: 1100)
                3'-AUUGAUGUAAAUACAAAAUUUACUCCU-5'  (SEQ ID NO: 380)
MET-414 Target: 5'-TAACTACATTTATGTTTTAAATGAGGA-3'  (SEQ ID NO: 740)

5'-CUACAUUUAUGUUUUAAAUGAGGAA-3'   (SEQ ID NO: 1101)
                3'-UUGAUGUAAAUACAAAAUUUACUCCUU-5'  (SEQ ID NO: 381)
MET-415 Target: 5'-AACTACATTTATGTTTTAAATGAGGAA-3'  (SEQ ID NO: 741)

5'-UACAUUUAUGUUUUAAAUGAGGAAG-3'   (SEQ ID NO: 1102)
                3'-UGAUGUAAAUACAAAAUUUACUCCUUC-5'  (SEQ ID NO: 382)
MET-416 Target: 5'-ACTACATTTATGTTTTAAATGAGGAAG-3'  (SEQ ID NO: 742)

5'-ACAUUUAUGUUUUAAAUGAGGAAGA-3'   (SEQ ID NO: 1103)
                3'-GAUGUAAAUACAAAAUUUACUCCUUCU-5'  (SEQ ID NO: 383)
MET-417 Target: 5'-CTACATTTATGTTTTAAATGAGGAAGA-3'  (SEQ ID NO: 743)

5'-UGGAACACCCAGAUUGUUUCCCAUG-3'   (SEQ ID NO: 1104)
                3'-CGACCUUGUGGGUCUAACAAAGGGUAC-5'  (SEQ ID NO: 384)
MET-480 Target: 5'-GCTGGAACACCCAGATTGTTTCCCATG-3'  (SEQ ID NO: 744)

5'-GGACUGCAGCAGCAAAGCCAAUUUA-3'   (SEQ ID NO: 1105)
                3'-GUCCUGACGUCGUCGUUUCGGUUAAAU-5'  (SEQ ID NO: 385)
MET-508 Target: 5'-CAGGACTGCAGCAGCAAAGCCAATTTA-3'  (SEQ ID NO: 745)

5'-GACUGCAGCAGCAAAGCCAAUUUAU-3'   (SEQ ID NO: 1106)
                3'-UCCUGACGUCGUCGUUUCGGUUAAAUA-5'  (SEQ ID NO: 386)
MET-509 Target: 5'-AGGACTGCAGCAGCAAAGCCAATTTAT-3'  (SEQ ID NO: 746)

5'-ACUGCAGCAGCAAAGCCAAUUUAUC-3'   (SEQ ID NO: 1107)
                3'-CCUGACGUCGUCGUUUCGGUUAAAUAG-5'  (SEQ ID NO: 387)
MET-510 Target: 5'-GGACTGCAGCAGCAAAGCCAATTTATC-3'  (SEQ ID NO: 747)

5'-CUGCAGCAGCAAAGCCAAUUUAUCA-3'   (SEQ ID NO: 1108)
                3'-CUGACGUCGUCGUUUCGGUUAAAUAGU-5'  (SEQ ID NO: 388)
MET-511 Target: 5'-GACTGCAGCAGCAAAGCCAATTTATCA-3'  (SEQ ID NO: 748)
```

TABLE 3-continued

Selected Human Anti-MET DsiRNAs, Unmodified Duplexes (Asymmetrics)

```
                5'-UGCAGCAGCAAAGCCAAUUUAUCAG-3'    (SEQ ID NO: 1109)
                3'-UGACGUCGUCGUUUCGGUUAAAUAGUC-5'  (SEQ ID NO: 389)
MET-512 Target: 5'-ACTGCAGCAGCAAAGCCAATTTATCAG-3'  (SEQ ID NO: 749)

5'-UACUAUGAUGAUCAACUCAUUAGCU-3'    (SEQ ID NO: 1110)
                3'-GGAUGAUACUACUAGUUGAGUAAUCGA-5'  (SEQ ID NO: 390)
MET-584 Target: 5'-CCTACTATGATGATCAACTCATTAGCT-3'  (SEQ ID NO: 750)

5'-ACUAUGAUGAUCAACUCAUUAGCUG-3'    (SEQ ID NO: 1111)
                3'-GAUGAUACUACUAGUUGAGUAAUCGAC-5'  (SEQ ID NO: 391)
MET-585 Target: 5'-CTACTATGATGATCAACTCATTAGCTG-3'  (SEQ ID NO: 751)

5'-CUAUGAUGAUCAACUCAUUAGCUGU-3'    (SEQ ID NO: 1112)
                3'-AUGAUACUACUAGUUGAGUAAUCGACA-5'  (SEQ ID NO: 392)
MET-586 Target: 5'-TACTATGATGATCAACTCATTAGCTGT-3'  (SEQ ID NO: 752)

5'-UAUGAUGAUCAACUCAUUAGCUGUG-3'    (SEQ ID NO: 1113)
                3'-UGAUACUACUAGUUGAGUAAUCGACAC-5'  (SEQ ID NO: 393)
MET-587 Target: 5'-ACTATGATGATCAACTCATTAGCTGTG-3'  (SEQ ID NO: 753)

5'-AUGAUGAUCAACUCAUUAGCUGUGG-3'    (SEQ ID NO: 1114)
                3'-GAUACUACUAGUUGAGUAAUCGACACC-5'  (SEQ ID NO: 394)
MET-588 Target: 5'-CTATGATGATCAACTCATTAGCTGTGG-3'  (SEQ ID NO: 754)

5'-UGAUGAUCAACUCAUUAGCUGUGGC-3'    (SEQ ID NO: 1115)
                3'-AUACUACUAGUUGAGUAAUCGACACCG-5'  (SEQ ID NO: 395)
MET-589 Target: 5'-TATGATGATCAACTCATTAGCTGTGGC-3'  (SEQ ID NO: 755)

5'-GAUGAUCAACUCAUUAGCUGUGGCA-3'    (SEQ ID NO: 1116)
                3'-UACUACUAGUUGAGUAAUCGACACCGU-5'  (SEQ ID NO: 396)
MET-590 Target: 5'-ATGATGATCAACTCATTAGCTGTGGCA-3'  (SEQ ID NO: 756)

5'-AUGAUCAACUCAUUAGCUGUGGCAG-3'    (SEQ ID NO: 1117)
                3'-ACUACUAGUUGAGUAAUCGACACCGUC-5'  (SEQ ID NO: 397)
MET-591 Target: 5'-TGATGATCAACTCATTAGCTGTGGCAG-3'  (SEQ ID NO: 757)

5'-UGAUCAACUCAUUAGCUGUGGCAGC-3'    (SEQ ID NO: 1118)
                3'-CUACUAGUUGAGUAAUCGACACCGUCG-5'  (SEQ ID NO: 398)
MET-592 Target: 5'-GATGATCAACTCATTAGCTGTGGCAGC-3'  (SEQ ID NO: 758)

5'-GAUCAACUCAUUAGCUGUGGCAGCG-3'    (SEQ ID NO: 1119)
                3'-UACUAGUUGAGUAAUCGACACCGUCGC-5'  (SEQ ID NO: 399)
MET-593 Target: 5'-ATGATCAACTCATTAGCTGTGGCAGCG-3'  (SEQ ID NO: 759)

5'-AUCAACUCAUUAGCUGUGGCAGCGU-3'    (SEQ ID NO: 1120)
                3'-ACUAGUUGAGUAAUCGACACCGUCGCA-5'  (SEQ ID NO: 400)
MET-594 Target: 5'-TGATCAACTCATTAGCTGTGGCAGCGT-3'  (SEQ ID NO: 760)

5'-UCAACUCAUUAGCUGUGGCAGCGUC-3'    (SEQ ID NO: 1121)
                3'-CUAGUUGAGUAAUCGACACCGUCGCAG-5'  (SEQ ID NO: 401)
MET-595 Target: 5'-GATCAACTCATTAGCTGTGGCAGCGTC-3'  (SEQ ID NO: 761)

5'-CAACUCAUUAGCUGUGGCAGCGUCA-3'    (SEQ ID NO: 1122)
                3'-UAGUUGAGUAAUCGACACCGUCGCAGU-5'  (SEQ ID NO: 402)
MET-596 Target: 5'-ATCAACTCATTAGCTGTGGCAGCGTCA-3'  (SEQ ID NO: 762)

5'-AACUCAUUAGCUGUGGCAGCGUCAA-3'    (SEQ ID NO: 1123)
                3'-AGUUGAGUAAUCGACACCGUCGCAGUU-5'  (SEQ ID NO: 403)
MET-597 Target: 5'-TCAACTCATTAGCTGTGGCAGCGTCAA-3'  (SEQ ID NO: 763)

5'-GAUGGUUUUAUGUUUUUGACGGACC-3'    (SEQ ID NO: 1124)
                3'-UUCUACCAAAAUACAAAAACUGCCUGG-5'  (SEQ ID NO: 404)
MET-881 Target: 5'-AAGATGGTTTTATGTTTTTGACGGACC-3'  (SEQ ID NO: 764)

5'-CUUUGAAAGCAACAAUUUUAUUUAC-3'    (SEQ ID NO: 1125)
                3'-CGGAAACUUUCGUUGUUAAAAUAAAUG-5'  (SEQ ID NO: 405)
MET-967 Target: 5'-GCCTTTGAAAGCAACAATTTTATTTAC-3'  (SEQ ID NO: 765)

5'-GGAAACUCUAGAUGCUCAGACUUUU-3'    (SEQ ID NO: 1126)
                3'-UCCCUUUGAGAUCUACGAGUCUGAAAA-5'  (SEQ ID NO: 406)
MET-1009 Target: 5'-AGGGAAACTCTAGATGCTCAGACTTTT-3' (SEQ ID NO: 766)

5'-GAAACUCUAGAUGCUCAGACUUUUC-3'    (SEQ ID NO: 1127)
                3'-CCCUUUGAGAUCUACGAGUCUGAAAAG-5'  (SEQ ID NO: 407)
MET-1010 Target: 5'-GGGAAACTCTAGATGCTCAGACTTTTC-3' (SEQ ID NO: 767)
```

TABLE 3-continued

Selected Human Anti-MET DsiRNAs, Unmodified Duplexes (Asymmetrics)

```
              5'-AAACUCUAGAUGCUCAGACUUUUCA-3'      (SEQ ID NO: 1128)
              3'-CCUUUGAGAUCUACGAGUCUGAAAAGU-5'    (SEQ ID NO:  408)
MET-1011 Target: 5'-GGAAACTCTAGATGCTCAGACTTTTCA-3' (SEQ ID NO:  768)

5'-AACUCUAGAUGCUCAGACUUUUCAC-3'      (SEQ ID NO: 1129)
              3'-CUUUGAGAUCUACGAGUCUGAAAAGUG-5'    (SEQ ID NO:  409)
MET-1012 Target: 5'-GAAACTCTAGATGCTCAGACTTTTCAC-3' (SEQ ID NO:  769)

5'-ACUCUAGAUGCUCAGACUUUUCACA-3'      (SEQ ID NO: 1130)
              3'-UUUGAGAUCUACGAGUCUGAAAAGUGU-5'    (SEQ ID NO:  410)
MET-1013 Target: 5'-AAACTCTAGATGCTCAGACTTTTCACA-3' (SEQ ID NO:  770)

5'-CUCUAGAUGCUCAGACUUUUCACAC-3'      (SEQ ID NO: 1131)
              3'-UUGAGAUCUACGAGUCUGAAAAGUGUG-5'    (SEQ ID NO:  411)
MET-1014 Target: 5'-AACTCTAGATGCTCAGACTTTTCACAC-3' (SEQ ID NO:  771)

5'-CACAAGAAUAAUCAGGUUCUGUUCC-3'      (SEQ ID NO: 1132)
              3'-GUGUGUUCUUAUUAGUCCAAGACAAGG-5'    (SEQ ID NO:  412)
MET-1036 Target: 5'-CACACAAGAATAATCAGGTTCTGTTCC-3' (SEQ ID NO:  772)

5'-CAAGAAUAAUCAGGUUCUGUUCCAU-3'      (SEQ ID NO: 1133)
              3'-GUGUUCUUAUUAGUCCAAGACAAGGUA-5'    (SEQ ID NO:  413)
MET-1038 Target: 5'-CACAAGAATAATCAGGTTCTGTTCCAT-3' (SEQ ID NO:  773)

5'-AAGAAUAAUCAGGUUCUGUUCCAUA-3'      (SEQ ID NO: 1134)
              3'-UGUUCUUAUUAGUCCAAGACAAGGUAU-5'    (SEQ ID NO:  414)
MET-1039 Target: 5'-ACAAGAATAATCAGGTTCTGTTCCATA-3' (SEQ ID NO:  774)

5'-AGAAUAAUCAGGUUCUGUUCCAUAA-3'      (SEQ ID NO: 1135)
              3'-GUUCUUAUUAGUCCAAGACAAGGUAUU-5'    (SEQ ID NO:  415)
MET-1040 Target: 5'-CAAGAATAATCAGGTTCTGTTCCATAA-3' (SEQ ID NO:  775)

5'-GAAUAAUCAGGUUCUGUUCCAUAAA-3'      (SEQ ID NO: 1136)
              3'-UUCUUAUUAGUCCAAGACAAGGUAUUU-5'    (SEQ ID NO:  416)
MET-1041 Target: 5'-AAGAATAATCAGGTTCTGTTCCATAAA-3' (SEQ ID NO:  776)

5'-AAUAAUCAGGUUCUGUUCCAUAAAC-3'      (SEQ ID NO: 1137)
              3'-UCUUAUUAGUCCAAGACAAGGUAUUUG-5'    (SEQ ID NO:  417)
MET-1042 Target: 5'-AGAATAATCAGGTTCTGTTCCATAAAC-3' (SEQ ID NO:  777)

5'-GUUCCAUAAACUCUGGAUUGCAUUC-3'      (SEQ ID NO: 1138)
              3'-GACAAGGUAUUUGAGACCUAACGUAAG-5'    (SEQ ID NO:  418)
MET-1056 Target: 5'-CTGTTCCATAAACTCTGGATTGCATTC-3' (SEQ ID NO:  778)

5'-GGAGUGUAUUCUCACAGAAAAGAGA-3'      (SEQ ID NO: 1139)
              3'-GACCUCACAUAAGAGUGUCUUUUCUCU-5'    (SEQ ID NO:  419)
MET-1099 Target: 5'-CTGGAGTGTATTCTCACAGAAAAGAGA-3' (SEQ ID NO:  779)

5'-GGAAGUGUUUAAUAUACUUCAGGCU-3'      (SEQ ID NO: 1140)
              3'-UUCCUUCACAAAUUAUAUGAAGUCCGA-5'    (SEQ ID NO:  420)
MET-1144 Target: 5'-AAGGAAGTGTTTAATATACTTCAGGCT-3' (SEQ ID NO:  780)

5'-CAGGCUGCGUAUGUCAGCAAGCCUG-3'      (SEQ ID NO: 1141)
              3'-AAGUCCGACGCAUACAGUCGUUCGGAC-5'    (SEQ ID NO:  421)
MET-1163 Target: 5'-TTCAGGCTGCGTATGTCAGCAAGCCTG-3' (SEQ ID NO:  781)

5'-GCACAAAGCAAGCCAGAUUCUGCCG-3'      (SEQ ID NO: 1142)
              3'-AGCGUGUUUCGUUCGGUCUAAGACGGC-5'    (SEQ ID NO:  422)
MET-1250 Target: 5'-TCGCACAAAGCAAGCCAGATTCTGCCG-3' (SEQ ID NO:  782)

5'-CACAAAGCAAGCCAGAUUCUGCCGA-3'      (SEQ ID NO: 1143)
              3'-GCGUGUUUCGUUCGGUCUAAGACGGCU-5'    (SEQ ID NO:  423)
MET-1251 Target: 5'-CGCACAAAGCAAGCCAGATTCTGCCGA-3' (SEQ ID NO:  783)

5'-ACAAAGCAAGCCAGAUUCUGCCGAA-3'      (SEQ ID NO: 1144)
              3'-CGUGUUUCGUUCGGUCUAAGACGGCUU-5'    (SEQ ID NO:  424)
MET-1252 Target: 5'-GCACAAAGCAAGCCAGATTCTGCCGAA-3' (SEQ ID NO:  784)

5'-CAAAGCAAGCCAGAUUCUGCCGAAC-3'      (SEQ ID NO: 1145)
              3'-GUGUUUCGUUCGGUCUAAGACGGCUUG-5'    (SEQ ID NO:  425)
MET-1253 Target: 5'-CACAAAGCAAGCCAGATTCTGCCGAAC-3' (SEQ ID NO:  785)

5'-AAAGCAAGCCAGAUUCUGCCGAACC-3'      (SEQ ID NO: 1146)
              3'-UGUUUCGUUCGGUCUAAGACGGCUUGG-5'    (SEQ ID NO:  426)
MET-1254 Target: 5'-ACAAAGCAAGCCAGATTCTGCCGAACC-3' (SEQ ID NO:  786)
```

TABLE 3-continued

Selected Human Anti-MET DsiRNAs, Unmodified Duplexes (Asymmetrics)

```
                    5'-GUGAGAUGUCUCCAGCAUUUUUACG-3'     (SEQ ID NO: 1147)
                    3'-UACACUCUACAGAGGUCGUAAAAAUGC-5'   (SEQ ID NO: 427)
MET-1358 Target:    5'-ATGTGAGATGTCTCCAGCATTTTTACG-3'   (SEQ ID NO: 787)

5'-UGAGAUGUCUCCAGCAUUUUUACGG-3'     (SEQ ID NO: 1148)
                    3'-ACACUCUACAGAGGUCGUAAAAAUGCC-5'   (SEQ ID NO: 428)
MET-1359 Target:    5'-TGTGAGATGTCTCCAGCATTTTTACGG-3'   (SEQ ID NO: 788)

5'-GAGAUGUCUCCAGCAUUUUUACGGA-3'     (SEQ ID NO: 1149)
                    3'-CACUCUACAGAGGUCGUAAAAAUGCCU-5'   (SEQ ID NO: 429)
MET-1360 Target:    5'-GTGAGATGTCTCCAGCATTTTTACGGA-3'   (SEQ ID NO: 789)

5'-AGAUGUCUCCAGCAUUUUUACGGAC-3'     (SEQ ID NO: 1150)
                    3'-ACUCUACAGAGGUCGUAAAAAUGCCUG-5'   (SEQ ID NO: 430)
MET-1361 Target:    5'-TGAGATGTCTCCAGCATTTTTACGGAC-3'   (SEQ ID NO: 790)

5'-GAUGUCUCCAGCAUUUUUACGGACC-3'     (SEQ ID NO: 1151)
                    3'-CUCUACAGAGGUCGUAAAAAUGCCUGG-5'   (SEQ ID NO: 431)
MET-1362 Target:    5'-GAGATGTCTCCAGCATTTTTACGGACC-3'   (SEQ ID NO: 791)

5'-AUGUCUCCAGCAUUUUUACGGACCC-3'     (SEQ ID NO: 1152)
                    3'-UCUACAGAGGUCGUAAAAAUGCCUGGG-5'   (SEQ ID NO: 432)
MET-1363 Target:    5'-AGATGTCTCCAGCATTTTTACGGACCC-3'   (SEQ ID NO: 792)

5'-UGUCUCCAGCAUUUUUACGGACCCA-3'     (SEQ ID NO: 1153)
                    3'-CUACAGAGGUCGUAAAAAUGCCUGGGU-5'   (SEQ ID NO: 433)
MET-1364 Target:    5'-GATGTCTCCAGCATTTTTACGGACCCA-3'   (SEQ ID NO: 793)

5'-GUCUCCAGCAUUUUUACGGACCCAA-3'     (SEQ ID NO: 1154)
                    3'-UACAGAGGUCGUAAAAAUGCCUGGGUU-5'   (SEQ ID NO: 434)
MET-1365 Target:    5'-ATGTCTCCAGCATTTTTACGGACCCAA-3'   (SEQ ID NO: 794)

5'-UCUCCAGCAUUUUUACGGACCCAAU-3'     (SEQ ID NO: 1155)
                    3'-ACAGAGGUCGUAAAAAUGCCUGGGUUA-5'   (SEQ ID NO: 435)
MET-1366 Target:    5'-TGTCTCCAGCATTTTTACGGACCCAAT-3'   (SEQ ID NO: 795)

5'-CUCCAGCAUUUUUACGGACCCAAUC-3'     (SEQ ID NO: 1156)
                    3'-CAGAGGUCGUAAAAAUGCCUGGGUUAG-5'   (SEQ ID NO: 436)
MET-1367 Target:    5'-GTCTCCAGCATTTTTACGGACCCAATC-3'   (SEQ ID NO: 796)

5'-UCCAGCAUUUUUACGGACCCAAUCA-3'     (SEQ ID NO: 1157)
                    3'-AGAGGUCGUAAAAAUGCCUGGGUUAGU-5'   (SEQ ID NO: 437)
MET-1368 Target:    5'-TCTCCAGCATTTTTACGGACCCAATCA-3'   (SEQ ID NO: 797)

5'-CCAGCAUUUUUACGGACCCAAUCAU-3'     (SEQ ID NO: 1158)
                    3'-GAGGUCGUAAAAAUGCCUGGGUUAGUA-5'   (SEQ ID NO: 438)
MET-1369 Target:    5'-CTCCAGCATTTTTACGGACCCAATCAT-3'   (SEQ ID NO: 798)

5'-CAGCAUUUUUACGGACCCAAUCAUG-3'     (SEQ ID NO: 1159)
                    3'-AGGUCGUAAAAAUGCCUGGGUUAGUAC-5'   (SEQ ID NO: 439)
MET-1370 Target:    5'-TCCAGCATTTTTACGGACCCAATCATG-3'   (SEQ ID NO: 799)

5'-AGCAUUUUUACGGACCCAAUCAUGA-3'     (SEQ ID NO: 1160)
                    3'-GGUCGUAAAAAUGCCUGGGUUAGUACU-5'   (SEQ ID NO: 440)
MET-1371 Target:    5'-CCAGCATTTTTACGGACCCAATCATGA-3'   (SEQ ID NO: 800)

5'-UUUACCACAGCUUUGCAGCGCGUUG-3'     (SEQ ID NO: 1161)
                    3'-UCAAAUGGUGUCGAAACGUCGCGCAAC-5'   (SEQ ID NO: 441)
MET-1469 Target:    5'-AGTTTACCACAGCTTTGCAGCGCGTTG-3'   (SEQ ID NO: 801)

5'-UACCACAGCUUUGCAGCGCGUUGAC-3'     (SEQ ID NO: 1162)
                    3'-AAAUGGUGUCGAAACGUCGCGCAACUG-5'   (SEQ ID NO: 442)
MET-1471 Target:    5'-TTTACCACAGCTTTGCAGCGCGTTGAC-3'   (SEQ ID NO: 802)

5'-CCACAGCUUUGCAGCGCGUUGACUU-3'     (SEQ ID NO: 1163)
                    3'-AUGGUGUCGAAACGUCGCGCAACUGAA-5'   (SEQ ID NO: 443)
MET-1473 Target:    5'-TACCACAGCTTTGCAGCGCGTTGACTT-3'   (SEQ ID NO: 803)

5'-CACAGCUUUGCAGCGCGUUGACUUA-3'     (SEQ ID NO: 1164)
                    3'-UGGUGUCGAAACGUCGCGCAACUGAAU-5'   (SEQ ID NO: 444)
MET-1474 Target:    5'-ACCACAGCTTTGCAGCGCGTTGACTTA-3'   (SEQ ID NO: 804)

5'-CAGCUUUGCAGCGCGUUGACUUAUU-3'     (SEQ ID NO: 1165)
                    3'-GUGUCGAAACGUCGCGCAACUGAAUAA-5'   (SEQ ID NO: 445)
MET-1476 Target:    5'-CACAGCTTTGCAGCGCGTTGACTTATT-3'   (SEQ ID NO: 805)
```

TABLE 3-continued

Selected Human Anti-MET DsiRNAs, Unmodified Duplexes (Asymmetrics)

```
              5'-GCUUUGCAGCGCGUUGACUUAUUCA-3'    (SEQ ID NO: 1166)
              3'-GUCGAAACGUCGCGCAACUGAAUAAGU-5'  (SEQ ID NO:  446)
MET-1478 Target: 5'-CAGCTTTGCAGCGCGTTGACTTATTCA-3' (SEQ ID NO:  806)

5'-CUUUGCAGCGCGUUGACUUAUUCAU-3'    (SEQ ID NO: 1167)
              3'-UCGAAACGUCGCGCAACUGAAUAAGUA-5'  (SEQ ID NO:  447)
MET-1479 Target: 5'-AGCTTTGCAGCGCGTTGACTTATTCAT-3' (SEQ ID NO:  807)

5'-UUUGCAGCGCGUUGACUUAUUCAUG-3'    (SEQ ID NO: 1168)
              3'-CGAAACGUCGCGCAACUGAAUAAGUAC-5'  (SEQ ID NO:  448)
MET-1480 Target: 5'-GCTTTGCAGCGCGTTGACTTATTCATG-3' (SEQ ID NO:  808)

5'-UUGCAGCGCGUUGACUUAUUCAUGG-3'    (SEQ ID NO: 1169)
              3'-GAAACGUCGCGCAACUGAAUAAGUACC-5'  (SEQ ID NO:  449)
MET-1481 Target: 5'-CTTTGCAGCGCGTTGACTTATTCATGG-3' (SEQ ID NO:  809)

5'-UGACCAUAUGUGGCUGGGACUUUGG-3'    (SEQ ID NO: 1170)
              3'-CGACUGGUAUACACCGACCCUGAAACC-5'  (SEQ ID NO:  450)
MET-1953 Target: 5'-GCTGACCATATGTGGCTGGGACTTTGG-3' (SEQ ID NO:  810)

5'-GACCAUAUGUGGCUGGGACUUUGGA-3'    (SEQ ID NO: 1171)
              3'-GACUGGUAUACACCGACCCUGAAACCU-5'  (SEQ ID NO:  451)
MET-1954 Target: 5'-CTGACCATATGTGGCTGGGACTTTGGA-3' (SEQ ID NO:  811)

5'-ACCAUAUGUGGCUGGGACUUUGGAU-3'    (SEQ ID NO: 1172)
              3'-ACUGGUAUACACCGACCCUGAAACCUA-5'  (SEQ ID NO:  452)
MET-1955 Target: 5'-TGACCATATGTGGCTGGGACTTTGGAT-3' (SEQ ID NO:  812)

5'-CCAUAUGUGGCUGGGACUUUGGAUU-3'    (SEQ ID NO: 1173)
              3'-CUGGUAUACACCGACCCUGAAACCUAA-5'  (SEQ ID NO:  453)
MET-1956 Target: 5'-GACCATATGTGGCTGGGACTTTGGATT-3' (SEQ ID NO:  813)

5'-CAUAUGUGGCUGGGACUUUGGAUUU-3'    (SEQ ID NO: 1174)
              3'-UGGUAUACACCGACCCUGAAACCUAAA-5'  (SEQ ID NO:  454)
MET-1957 Target: 5'-ACCATATGTGGCTGGGACTTTGGATTT-3' (SEQ ID NO:  814)

5'-AUAUGUGGCUGGGACUUUGGAUUUC-3'    (SEQ ID NO: 1175)
              3'-GGUAUACACCGACCCUGAAACCUAAAG-5'  (SEQ ID NO:  455)
MET-1958 Target: 5'-CCATATGTGGCTGGGACTTTGGATTTC-3' (SEQ ID NO:  815)

5'-UAUGUGGCUGGGACUUUGGAUUUCG-3'    (SEQ ID NO: 1176)
              3'-GUAUACACCGACCCUGAAACCUAAAGC-5'  (SEQ ID NO:  456)
MET-1959 Target: 5'-CATATGTGGCTGGGACTTTGGATTTCG-3' (SEQ ID NO:  816)

5'-AUGUGGCUGGGACUUUGGAUUUCGG-3'    (SEQ ID NO: 1177)
              3'-UAUACACCGACCCUGAAACCUAAAGCC-5'  (SEQ ID NO:  457)
MET-1960 Target: 5'-ATATGTGGCTGGGACTTTGGATTTCGG-3' (SEQ ID NO:  817)

5'-UGUGGCUGGGACUUUGGAUUUCGGA-3'    (SEQ ID NO: 1178)
              3'-AUACACCGACCCUGAAACCUAAAGCCU-5'  (SEQ ID NO:  458)
MET-1961 Target: 5'-TATGTGGCTGGGACTTTGGATTTCGGA-3' (SEQ ID NO:  818)

5'-GUGGCUGGGACUUUGGAUUUCGGAG-3'    (SEQ ID NO: 1179)
              3'-UACACCGACCCUGAAACCUAAAGCCUC-5'  (SEQ ID NO:  459)
MET-1962 Target: 5'-ATGTGGCTGGGACTTTGGATTTCGGAG-3' (SEQ ID NO:  819)

5'-CGGAGGAAUAAUAAAUUUGAUUUAA-3'    (SEQ ID NO: 1180)
              3'-AAGCCUCCUUAUUAUUUAAACUAAAUU-5'  (SEQ ID NO:  460)
MET-1982 Target: 5'-TTCGGAGGAATAATAAATTTGATTTAA-3' (SEQ ID NO:  820)

5'-GAAUAAUAAAUUUGAUUUAAAGAAA-3'    (SEQ ID NO: 1181)
              3'-UCCUUAUUAUUUAAACUAAAUUUCUUU-5'  (SEQ ID NO:  461)
MET-1987 Target: 5'-AGGAATAATAAATTTGATTTAAAGAAA-3' (SEQ ID NO:  821)

5'-AAUAAUAAAUUUGAUUUAAAGAAAA-3'    (SEQ ID NO: 1182)
              3'-CCUUAUUAUUUAAACUAAAUUUCUUUU-5'  (SEQ ID NO:  462)
MET-1988 Target: 5'-GGAATAATAAATTTGATTTAAAGAAAA-3' (SEQ ID NO:  822)

5'-UUGAAAUGCACAGUUGGUCCUGCCA-3'    (SEQ ID NO: 1183)
              3'-GUAACUUUACGUGUCAACCAGGACGGU-5'  (SEQ ID NO:  463)
MET-2075 Target: 5'-CATTGAAATGCACAGTTGGTCCTGCCA-3' (SEQ ID NO:  823)

5'-UGAAAUGCACAGUUGGUCCUGCCAU-3'    (SEQ ID NO: 1184)
              3'-UAACUUUACGUGUCAACCAGGACGGUA-5'  (SEQ ID NO:  464)
MET-2076 Target: 5'-ATTGAAATGCACAGTTGGTCCTGCCAT-3' (SEQ ID NO:  824)
```

TABLE 3-continued

Selected Human Anti-MET DsiRNAs, Unmodified Duplexes (Asymmetrics)

```
              5'-CAAUAUGUCCAUAAUUAUUUCAAAU-3'    (SEQ ID NO: 1185)
              3'-AAGUUAUACAGGUAUUAAUAAAGUUUA-5'  (SEQ ID NO: 465)
MET-2113 Target: 5'-TTCAATATGTCCATAATTATTTCAAAT-3' (SEQ ID NO: 825)

5'-UGGAAAAACAUGUACUUUAAAAAGU-3'    (SEQ ID NO: 1186)
              3'-CCACCUUUUUGUACAUGAAAUUUUCA-5'   (SEQ ID NO: 466)
MET-2290 Target: 5'-GGTGGAAAAACATGTACTTTAAAAAGT-3' (SEQ ID NO: 826)

5'-UACCACUCCUUCCCUGCAACAGCUG-3'    (SEQ ID NO: 1187)
              3'-ACAUGGUGAGGAAGGGACGUUGUCGAC-5'  (SEQ ID NO: 467)
MET-2668 Target: 5'-TGTACCACTCCTTCCCTGCAACAGCTG-3' (SEQ ID NO: 827)

5'-AGCCUUUUGAAAAGCCAGUGAUGAU-3'    (SEQ ID NO: 1188)
              3'-AUUCGGAAAACUUUUCGGUCACUACUA-5'  (SEQ ID NO: 468)
MET-2790 Target: 5'-TAAGCCTTTTGAAAAGCCAGTGATGAT-3' (SEQ ID NO: 828)

5'-AUAUUGACCCUGAAGCAGUUAAAGG-3'    (SEQ ID NO: 1189)
              3'-ACUAUAACUGGGACUUCGUCAAUUUCC-5'  (SEQ ID NO: 469)
MET-2856 Target: 5'-TGATATTGACCCTGAAGCAGTTAAAGG-3' (SEQ ID NO: 829)

5'-UAUUGACCCUGAAGCAGUUAAAGGU-3'    (SEQ ID NO: 1190)
              3'-CUAUAACUGGGACUUCGUCAAUUUCCA-5'  (SEQ ID NO: 470)
MET-2857 Target: 5'-GATATTGACCCTGAAGCAGTTAAAGGT-3' (SEQ ID NO: 830)

5'-AUUGACCCUGAAGCAGUUAAAGGUG-3'    (SEQ ID NO: 1191)
              3'-UAUAACUGGGACUUCGUCAAUUUCCAC-5'  (SEQ ID NO: 471)
MET-2858 Target: 5'-ATATTGACCCTGAAGCAGTTAAAGGTG-3' (SEQ ID NO: 831)

5'-UUGACCCUGAAGCAGUUAAAGGUGA-3'    (SEQ ID NO: 1192)
              3'-AUAACUGGGACUUCGUCAAUUUCCACU-5'  (SEQ ID NO: 472)
MET-2859 Target: 5'-TATTGACCCTGAAGCAGTTAAAGGTGA-3' (SEQ ID NO: 832)

5'-UGACCCUGAAGCAGUUAAAGGUGAA-3'    (SEQ ID NO: 1193)
              3'-UAACUGGGACUUCGUCAAUUUCCACUU-5'  (SEQ ID NO: 473)
MET-2860 Target: 5'-ATTGACCCTGAAGCAGTTAAAGGTGAA-3' (SEQ ID NO: 833)

5'-GACCCUGAAGCAGUUAAAGGUGAAG-3'    (SEQ ID NO: 1194)
              3'-AACUGGGACUUCGUCAAUUUCCACUUC-5'  (SEQ ID NO: 474)
MET-2861 Target: 5'-TTGACCCTGAAGCAGTTAAAGGTGAAG-3' (SEQ ID NO: 834)

5'-ACCCUGAAGCAGUUAAAGGUGAAGU-3'    (SEQ ID NO: 1195)
              3'-ACUGGGACUUCGUCAAUUUCCACUUCA-5'  (SEQ ID NO: 475)
MET-2862 Target: 5'-TGACCCTGAAGCAGTTAAAGGTGAAGT-3' (SEQ ID NO: 835)

5'-CCCUGAAGCAGUUAAAGGUGAAGUG-3'    (SEQ ID NO: 1196)
              3'-CUGGGACUUCGUCAAUUUCCACUUCAC-5'  (SEQ ID NO: 476)
MET-2863 Target: 5'-GACCCTGAAGCAGTTAAAGGTGAAGTG-3' (SEQ ID NO: 836)

5'-CCUGAAGCAGUUAAAGGUGAAGUGU-3'    (SEQ ID NO: 1197)
              3'-UGGGACUUCGUCAAUUUCCACUUCACA-5'  (SEQ ID NO: 477)
MET-2864 Target: 5'-ACCCTGAAGCAGTTAAAGGTGAAGTGT-3' (SEQ ID NO: 837)

5'-CUGAAGCAGUUAAAGGUGAAGUGUU-3'    (SEQ ID NO: 1198)
              3'-GGGACUUCGUCAAUUUCCACUUCACAA-5'  (SEQ ID NO: 478)
MET-2865 Target: 5'-CCCTGAAGCAGTTAAAGGTGAAGTGTT-3' (SEQ ID NO: 838)

5'-UGAAGCAGUUAAAGGUGAAGUGUUA-3'    (SEQ ID NO: 1199)
              3'-GGACUUCGUCAAUUUCCACUUCACAAU-5'  (SEQ ID NO: 479)
MET-2866 Target: 5'-CCTGAAGCAGTTAAAGGTGAAGTGTTA-3' (SEQ ID NO: 839)

5'-GAAGCAGUUAAAGGUGAAGUGUUAA-3'    (SEQ ID NO: 1200)
              3'-GACUUCGUCAAUUUCCACUUCACAAUU-5'  (SEQ ID NO: 480)
MET-2867 Target: 5'-CTGAAGCAGTTAAAGGTGAAGTGTTAA-3' (SEQ ID NO: 840)

5'-AAGCAGUUAAAGGUGAAGUGUUAAA-3'    (SEQ ID NO: 1201)
              3'-ACUUCGUCAAUUUCCACUUCACAAUUU-5'  (SEQ ID NO: 481)
MET-2868 Target: 5'-TGAAGCAGTTAAAGGTGAAGTGTTAAA-3' (SEQ ID NO: 841)

5'-AGCAGUUAAAGGUGAAGUGUUAAAA-3'    (SEQ ID NO: 1202)
              3'-CUUCGUCAAUUUCCACUUCACAAUUUU-5'  (SEQ ID NO: 482)
MET-2869 Target: 5'-GAAGCAGTTAAAGGTGAAGTGTTAAAA-3' (SEQ ID NO: 842)

5'-GCAGUUAAAGGUGAAGUGUUAAAAG-3'    (SEQ ID NO: 1203)
              3'-UUCGUCAAUUUCCACUUCACAAUUUUC-5'  (SEQ ID NO: 483)
MET-2870 Target: 5'-AAGCAGTTAAAGGTGAAGTGTTAAAAG-3' (SEQ ID NO: 843)
```

TABLE 3-continued

Selected Human Anti-MET DsiRNAs, Unmodified Duplexes (Asymmetrics)

```
             5'-CAGUUAAAGGUGAAGUGUUAAAAGU-3'     (SEQ ID NO: 1204)
             3'-UCGUCAAUUUCCACUUCACAAUUUUCA-5'   (SEQ ID NO: 484)
MET-2871 Target: 5'-AGCAGTTAAAGGTGAAGTGTTAAAAGT-3' (SEQ ID NO: 844)

5'-AGUUAAAGGUGAAGUGUUAAAAGUU-3'    (SEQ ID NO: 1205)
             3'-CGUCAAUUUCCACUUCACAAUUUUCAA-5'  (SEQ ID NO: 485)
MET-2872 Target: 5'-GCAGTTAAAGGTGAAGTGTTAAAAGTT-3' (SEQ ID NO: 845)

5'-GUUAAAGGUGAAGUGUUAAAAGUUG-3'    (SEQ ID NO: 1206)
             3'-GUCAAUUUCCACUUCACAAUUUUCAAC-5'  (SEQ ID NO: 486)
MET-2873 Target: 5'-CAGTTAAAGGTGAAGTGTTAAAAGTTG-3' (SEQ ID NO: 846)

5'-UUAAAGGUGAAGUGUUAAAAGUUGG-3'    (SEQ ID NO: 1207)
             3'-UCAAUUUCCACUUCACAAUUUUCAACC-5'  (SEQ ID NO: 487)
MET-2874 Target: 5'-AGTTAAAGGTGAAGTGTTAAAAGTTGG-3' (SEQ ID NO: 847)

5'-UAAAGGUGAAGUGUUAAAAGUUGGA-3'    (SEQ ID NO: 1208)
             3'-CAAUUUCCACUUCACAAUUUUCAACCU-5'  (SEQ ID NO: 488)
MET-2875 Target: 5'-GTTAAAGGTGAAGTGTTAAAAGTTGGA-3' (SEQ ID NO: 848)

5'-AAAGGUGAAGUGUUAAAAGUUGGAA-3'    (SEQ ID NO: 1209)
             3'-AAUUUCCACUUCACAAUUUUCAACCUU-5'  (SEQ ID NO: 489)
MET-2876 Target: 5'-TTAAAGGTGAAGTGTTAAAAGTTGGAA-3' (SEQ ID NO: 849)

5'-AAGGUGAAGUGUUAAAAGUUGGAAA-3'    (SEQ ID NO: 1210)
             3'-AUUUCCACUUCACAAUUUUCAACCUUU-5'  (SEQ ID NO: 490)
MET-2877 Target: 5'-TAAAGGTGAAGTGTTAAAAGTTGGAAA-3' (SEQ ID NO: 850)

5'-AGGUGAAGUGUUAAAAGUUGGAAAU-3'    (SEQ ID NO: 1211)
             3'-UUUCCACUUCACAAUUUUCAACCUUUA-5'  (SEQ ID NO: 491)
MET-2878 Target: 5'-AAAGGTGAAGTGTTAAAAGTTGGAAAT-3' (SEQ ID NO: 851)

5'-GGUGAAGUGUUAAAAGUUGGAAAUA-3'    (SEQ ID NO: 1212)
             3'-UUCCACUUCACAAUUUUCAACCUUUAU-5'  (SEQ ID NO: 492)
MET-2879 Target: 5'-AAGGTGAAGTGTTAAAAGTTGGAAATA-3' (SEQ ID NO: 852)

5'-GUGAAGUGUUAAAAGUUGGAAAUAA-3'    (SEQ ID NO: 1213)
             3'-UCCACUUCACAAUUUUCAACCUUUAUU-5'  (SEQ ID NO: 493)
MET-2880 Target: 5'-AGGTGAAGTGTTAAAAGTTGGAAATAA-3' (SEQ ID NO: 853)

5'-UGAAGUGUUAAAAGUUGGAAAUAAG-3'    (SEQ ID NO: 1214)
             3'-CCACUUCACAAUUUUCAACCUUUAUUC-5'  (SEQ ID NO: 494)
MET-2881 Target: 5'-GGTGAAGTGTTAAAAGTTGGAAATAAG-3' (SEQ ID NO: 854)

5'-GAAGUGUUAAAAGUUGGAAAUAAGA-3'    (SEQ ID NO: 1215)
             3'-CACUUCACAAUUUUCAACCUUUAUUCU-5'  (SEQ ID NO: 495)
MET-2882 Target: 5'-GTGAAGTGTTAAAAGTTGGAAATAAGA-3' (SEQ ID NO: 855)

5'-AAGUGUUAAAAGUUGGAAAUAAGAG-3'    (SEQ ID NO: 1216)
             3'-ACUUCACAAUUUUCAACCUUUAUUCUC-5'  (SEQ ID NO: 496)
MET-2883 Target: 5'-TGAAGTGTTAAAAGTTGGAAATAAGAG-3' (SEQ ID NO: 856)

5'-AGUGUUAAAAGUUGGAAAUAAGAGC-3'    (SEQ ID NO: 1217)
             3'-CUUCACAAUUUUCAACCUUUAUUCUCG-5'  (SEQ ID NO: 497)
MET-2884 Target: 5'-GAAGTGTTAAAAGTTGGAAATAAGAGC-3' (SEQ ID NO: 857)

5'-UGAACAGCGAGCUAAAUAUAGAGUG-3'    (SEQ ID NO: 1218)
             3'-UAACUUGUCGCUCGAUUUAUAUCUCAC-5'  (SEQ ID NO: 498)
MET-2973 Target: 5'-ATTGAACAGCGAGCTAAATATAGAGTG-3' (SEQ ID NO: 858)

5'-GAACAGCGAGCUAAAUAUAGAGUGG-3'    (SEQ ID NO: 1219)
             3'-AACUUGUCGCUCGAUUUAUAUCUCACC-5'  (SEQ ID NO: 499)
MET-2974 Target: 5'-TTGAACAGCGAGCTAAATATAGAGTGG-3' (SEQ ID NO: 859)

5'-AACAGCGAGCUAAAUAUAGAGUGGA-3'    (SEQ ID NO: 1220)
             3'-ACUUGUCGCUCGAUUUAUAUCUCACCU-5'  (SEQ ID NO: 500)
MET-2975 Target: 5'-TGAACAGCGAGCTAAATATAGAGTGGA-3' (SEQ ID NO: 860)

5'-ACAGCGAGCUAAAUAUAGAGUGGAA-3'    (SEQ ID NO: 1221)
             3'-CUUGUCGCUCGAUUUAUAUCUCACCUU-5'  (SEQ ID NO: 501)
MET-2976 Target: 5'-GAACAGCGAGCTAAATATAGAGTGGAA-3' (SEQ ID NO: 861)

5'-CAGCGAGCUAAAUAUAGAGUGGAAG-3'    (SEQ ID NO: 1222)
             3'-UUGUCGCUCGAUUUAUAUCUCACCUUC-5'  (SEQ ID NO: 502)
MET-2977 Target: 5'-AACAGCGAGCTAAATATAGAGTGGAAG-3' (SEQ ID NO: 862)
```

TABLE 3-continued

Selected Human Anti-MET DsiRNAs, Unmodified Duplexes (Asymmetrics)

```
                5'-AGCGAGCUAAAUAUAGAGUGGAAGC-3'    (SEQ ID NO: 1223)
                3'-UGUCGCUCGAUUUAUAUCUCACCUUCG-5'  (SEQ ID NO: 503)
MET-2978 Target: 5'-ACAGCGAGCTAAATATAGAGTGGAAGC-3' (SEQ ID NO: 863)

5'-GCGAGCUAAAUAUAGAGUGGAAGCA-3'    (SEQ ID NO: 1224)
                3'-GUCGCUCGAUUUAUAUCUCACCUUCGU-5'  (SEQ ID NO: 504)
MET-2979 Target: 5'-CAGCGAGCTAAATATAGAGTGGAAGCA-3' (SEQ ID NO: 864)

5'-CGAGCUAAAUAUAGAGUGGAAGCAA-3'    (SEQ ID NO: 1225)
                3'-UCGCUCGAUUUAUAUCUCACCUUCGUU-5'  (SEQ ID NO: 505)
MET-2980 Target: 5'-AGCGAGCTAAATATAGAGTGGAAGCAA-3' (SEQ ID NO: 865)

5'-GAGCUAAAUAUAGAGUGGAAGCAAG-3'    (SEQ ID NO: 1226)
                3'-CGCUCGAUUUAUAUCUCACCUUCGUUC-5'  (SEQ ID NO: 506)
MET-2981 Target: 5'-GCGAGCTAAATATAGAGTGGAAGCAAG-3' (SEQ ID NO: 866)

5'-AGCUAAAUAUAGAGUGGAAGCAAGC-3'    (SEQ ID NO: 1227)
                3'-GCUCGAUUUAUAUCUCACCUUCGUUCG-5'  (SEQ ID NO: 507)
MET-2982 Target: 5'-CGAGCTAAATATAGAGTGGAAGCAAGC-3' (SEQ ID NO: 867)

5'-GCUAAAUAUAGAGUGGAAGCAAGCA-3'    (SEQ ID NO: 1228)
                3'-CUCGAUUUAUAUCUCACCUUCGUUCGU-5'  (SEQ ID NO: 508)
MET-2983 Target: 5'-GAGCTAAATATAGAGTGGAAGCAAGCA-3' (SEQ ID NO: 868)

5'-CUAAAUAUAGAGUGGAAGCAAGCAA-3'    (SEQ ID NO: 1229)
                3'-UCGAUUUAUAUCUCACCUUCGUUCGUU-5'  (SEQ ID NO: 509)
MET-2984 Target: 5'-AGCTAAATATAGAGTGGAAGCAAGCAA-3' (SEQ ID NO: 869)

5'-UAAAUAUAGAGUGGAAGCAAGCAAU-3'    (SEQ ID NO: 1230)
                3'-CGAUUUAUAUCUCACCUUCGUUCGUUA-5'  (SEQ ID NO: 510)
MET-2985 Target: 5'-GCTAAATATAGAGTGGAAGCAAGCAAT-3' (SEQ ID NO: 870)

5'-AAAUAUAGAGUGGAAGCAAGCAAUU-3'    (SEQ ID NO: 1231)
                3'-GAUUUAUAUCUCACCUUCGUUCGUUAA-5'  (SEQ ID NO: 511)
MET-2986 Target: 5'-CTAAATATAGAGTGGAAGCAAGCAATT-3' (SEQ ID NO: 871)

5'-AAUAUAGAGUGGAAGCAAGCAAUUU-3'    (SEQ ID NO: 1232)
                3'-AUUUAUAUCUCACCUUCGUUCGUUAAA-5'  (SEQ ID NO: 512)
MET-2987 Target: 5'-TAAATATAGAGTGGAAGCAAGCAATTT-3' (SEQ ID NO: 872)

5'-AUAUAGAGUGGAAGCAAGCAAUUUC-3'    (SEQ ID NO: 1233)
                3'-UUUAUAUCUCACCUUCGUUCGUUAAAG-5'  (SEQ ID NO: 513)
MET-2988 Target: 5'-AAATATAGAGTGGAAGCAAGCAATTTC-3' (SEQ ID NO: 873)

5'-UAUAGAGUGGAAGCAAGCAAUUUCU-3'    (SEQ ID NO: 1234)
                3'-UUUAUAUCUCACCUUCGUUCGUUAAAGA-5' (SEQ ID NO: 514)
MET-2989 Target: 5'-AATATAGAGTGGAAGCAAGCAATTTCT-3' (SEQ ID NO: 874)

5'-UGGGUUUUUCCUGUGGCUGAAAAAG-3'    (SEQ ID NO: 1235)
                3'-GAACCCAAAAAGGACACCGACUUUUUC-5'  (SEQ ID NO: 515)
MET-3112 Target: 5'-CTTGGGTTTTCCTGTGGCTGAAAAAG-3'  (SEQ ID NO: 875)

5'-GGCUGAAAAAGAGAAAGCAAAUUAA-3'    (SEQ ID NO: 1236)
                3'-CACCGACUUUUUCUCUUUCGUUUAAUU-5'  (SEQ ID NO: 516)
MET-3126 Target: 5'-GTGGCTGAAAAGAGAAAGCAAATTAA-3'  (SEQ ID NO: 876)

5'-UAAAGAUCUGGGCAGUGAAUUAGUU-3'    (SEQ ID NO: 1237)
                3'-UAAUUUCUAGACCCGUCACUUAAUCAA-5'  (SEQ ID NO: 517)
MET-3148 Target: 5'-ATTAAAGATCTGGGCAGTGAATTAGTT-3' (SEQ ID NO: 877)

5'-AAAGAUCUGGGCAGUGAAUUAGUUC-3'    (SEQ ID NO: 1238)
                3'-AAUUUCUAGACCCGUCACUUAAUCAAG-5'  (SEQ ID NO: 518)
MET-3149 Target: 5'-TTAAAGATCTGGGCAGTGAATTAGTTC-3' (SEQ ID NO: 878)

5'-AAGAUCUGGGCAGUGAAUUAGUUCG-3'    (SEQ ID NO: 1239)
                3'-AUUUCUAGACCCGUCACUUAAUCAAGC-5'  (SEQ ID NO: 519)
MET-3150 Target: 5'-TAAAGATCTGGGCAGTGAATTAGTTCG-3' (SEQ ID NO: 879)

5'-AGAUCUGGGCAGUGAAUUAGUUCGC-3'    (SEQ ID NO: 1240)
                3'-UUUCUAGACCCGUCACUUAAUCAAGCG-5'  (SEQ ID NO: 520)
MET-3151 Target: 5'-AAAGATCTGGGCAGTGAATTAGTTCGC-3' (SEQ ID NO: 880)

5'-GAUCUGGGCAGUGAAUUAGUUCGCU-3'    (SEQ ID NO: 1241)
                3'-UUCUAGACCCGUCACUUAAUCAAGCGA-5'  (SEQ ID NO: 521)
MET-3152 Target: 5'-AAGATCTGGGCAGTGAATTAGTTCGCT-3' (SEQ ID NO: 881)
```

TABLE 3-continued

Selected Human Anti-MET DsiRNAs, Unmodified Duplexes (Asymmetrics)

```
                    5'-AUCUGGGCAGUGAAUUAGUUCGCUA-3'      (SEQ ID NO: 1242)
                    3'-UCUAGACCCGUCACUUAAUCAAGCGAU-5'    (SEQ ID NO: 522)
MET-3153 Target:    5'-AGATCTGGGCAGTGAATTAGTTCGCTA-3'    (SEQ ID NO: 882)

5'-UCUGGGCAGUGAAUUAGUUCGCUAC-3'      (SEQ ID NO: 1243)
                    3'-CUAGACCCGUCACUUAAUCAAGCGAUG-5'    (SEQ ID NO: 523)
MET-3154 Target:    5'-GATCTGGGCAGTGAATTAGTTCGCTAC-3'    (SEQ ID NO: 883)

5'-CUGGGCAGUGAAUUAGUUCGCUACG-3'      (SEQ ID NO: 1244)
                    3'-UAGACCCGUCACUUAAUCAAGCGAUGC-5'    (SEQ ID NO: 524)
MET-3155 Target:    5'-ATCTGGGCAGTGAATTAGTTCGCTACG-3'    (SEQ ID NO: 884)

5'-UGGGCAGUGAAUUAGUUCGCUACGA-3'      (SEQ ID NO: 1245)
                    3'-AGACCCGUCACUUAAUCAAGCGAUGCU-5'    (SEQ ID NO: 525)
MET-3156 Target:    5'-TCTGGGCAGTGAATTAGTTCGCTACGA-3'    (SEQ ID NO: 885)

5'-GGGCAGUGAAUUAGUUCGCUACGAU-3'      (SEQ ID NO: 1246)
                    3'-GACCCGUCACUUAAUCAAGCGAUGCUA-5'    (SEQ ID NO: 526)
MET-3157 Target:    5'-CTGGGCAGTGAATTAGTTCGCTACGAT-3'    (SEQ ID NO: 886)

5'-GGCAGUGAAUUAGUUCGCUACGAUG-3'      (SEQ ID NO: 1247)
                    3'-ACCCGUCACUUAAUCAAGCGAUGCUAC-5'    (SEQ ID NO: 527)
MET-3158 Target:    5'-TGGGCAGTGAATTAGTTCGCTACGATG-3'    (SEQ ID NO: 887)

5'-GCAGUGAAUUAGUUCGCUACGAUGC-3'      (SEQ ID NO: 1248)
                    3'-CCCGUCACUUAAUCAAGCGAUGCUACG-5'    (SEQ ID NO: 528)
MET-3159 Target:    5'-GGGCAGTGAATTAGTTCGCTACGATGC-3'    (SEQ ID NO: 888)

5'-CACUCCUCAUUUGGAUAGGCUUGUA-3'      (SEQ ID NO: 1249)
                    3'-GUGUGAGGAGUAAACCUAUCCGAACAU-5'    (SEQ ID NO: 529)
MET-3193 Target:    5'-CACACTCCTCATTTGGATAGGCTTGTA-3'    (SEQ ID NO: 889)

5'-ACUCCUCAUUUGGAUAGGCUUGUAA-3'      (SEQ ID NO: 1250)
                    3'-UGUGAGGAGUAAACCUAUCCGAACAUU-5'    (SEQ ID NO: 530)
MET-3194 Target:    5'-ACACTCCTCATTTGGATAGGCTTGTAA-3'    (SEQ ID NO: 890)

5'-CUCCUCAUUUGGAUAGGCUUGUAAG-3'      (SEQ ID NO: 1251)
                    3'-GUGAGGAGUAAACCUAUCCGAACAUUC-5'    (SEQ ID NO: 531)
MET-3195 Target:    5'-CACTCCTCATTTGGATAGGCTTGTAAG-3'    (SEQ ID NO: 891)

5'-UCCUCAUUUGGAUAGGCUUGUAAGU-3'      (SEQ ID NO: 1252)
                    3'-UGAGGAGUAAACCUAUCCGAACAUUCA-5'    (SEQ ID NO: 532)
MET-3196 Target:    5'-ACTCCTCATTTGGATAGGCTTGTAAGT-3'    (SEQ ID NO: 892)

5'-CCUCAUUUGGAUAGGCUUGUAAGUG-3'      (SEQ ID NO: 1253)
                    3'-GAGGAGUAAACCUAUCCGAACAUUCAC-5'    (SEQ ID NO: 533)
MET-3197 Target:    5'-CTCCTCATTTGGATAGGCTTGTAAGTG-3'    (SEQ ID NO: 893)

5'-CUCAUUUGGAUAGGCUUGUAAGUGC-3'      (SEQ ID NO: 1254)
                    3'-AGGAGUAAACCUAUCCGAACAUUCACG-5'    (SEQ ID NO: 534)
MET-3198 Target:    5'-TCCTCATTTGGATAGGCTTGTAAGTGC-3'    (SEQ ID NO: 894)

5'-UCAUUUGGAUAGGCUUGUAAGUGCC-3'      (SEQ ID NO: 1255)
                    3'-GGAGUAAACCUAUCCGAACAUUCACGG-5'    (SEQ ID NO: 535)
MET-3199 Target:    5'-CCTCATTTGGATAGGCTTGTAAGTGCC-3'    (SEQ ID NO: 895)

5'-CAUUUGGAUAGGCUUGUAAGUGCCC-3'      (SEQ ID NO: 1256)
                    3'-GAGUAAACCUAUCCGAACAUUCACGGG-5'    (SEQ ID NO: 536)
MET-3200 Target:    5'-CTCATTTGGATAGGCTTGTAAGTGCCC-3'    (SEQ ID NO: 896)

5'-AUUUGGAUAGGCUUGUAAGUGCCCG-3'      (SEQ ID NO: 1257)
                    3'-AGUAAACCUAUCCGAACAUUCACGGGC-5'    (SEQ ID NO: 537)
MET-3201 Target:    5'-TCATTTGGATAGGCTTGTAAGTGCCCG-3'    (SEQ ID NO: 897)

5'-UUUGGAUAGGCUUGUAAGUGCCCGA-3'      (SEQ ID NO: 1258)
                    3'-GUAAACCUAUCCGAACAUUCACGGGCU-5'    (SEQ ID NO: 538)
MET-3202 Target:    5'-CATTTGGATAGGCTTGTAAGTGCCCGA-3'    (SEQ ID NO: 898)

5'-UUGGAUAGGCUUGUAAGUGCCCGAA-3'      (SEQ ID NO: 1259)
                    3'-UAAACCUAUCCGAACAUUCACGGGCUU-5'    (SEQ ID NO: 539)
MET-3203 Target:    5'-ATTTGGATAGGCTTGTAAGTGCCCGAA-3'    (SEQ ID NO: 899)

5'-UGGAUAGGCUUGUAAGUGCCCGAAG-3'      (SEQ ID NO: 1260)
                    3'-AAACCUAUCCGAACAUUCACGGGCUUC-5'    (SEQ ID NO: 540)
MET-3204 Target:    5'-TTTGGATAGGCTTGTAAGTGCCCGAAG-3'    (SEQ ID NO: 900)
```

TABLE 3-continued

Selected Human Anti-MET DsiRNAs, Unmodified Duplexes (Asymmetrics)

```
              5'-GGAUAGGCUUGUAAGUGCCCGAAGU-3'     (SEQ ID NO: 1261)
              3'-AACCUAUCCGAACAUUCACGGGCUUCA-5'   (SEQ ID NO: 541)
MET-3205 Target: 5'-TTGGATAGGCTTGTAAGTGCCCGAAGT-3' (SEQ ID NO: 901)

5'-GAUAGGCUUGUAAGUGCCCGAAGUG-3'    (SEQ ID NO: 1262)
              3'-ACCUAUCCGAACAUUCACGGGCUUCAC-5'  (SEQ ID NO: 542)
MET-3206 Target: 5'-TGGATAGGCTTGTAAGTGCCCGAAGTG-3' (SEQ ID NO: 902)

5'-AUAGGCUUGUAAGUGCCCGAAGUGU-3'   (SEQ ID NO: 1263)
              3'-CCUAUCCGAACAUUCACGGGCUUCACA-5' (SEQ ID NO: 543)
MET-3207 Target: 5'-GGATAGGCTTGTAAGTGCCCGAAGTGT-3' (SEQ ID NO: 903)

5'-UAGGCUUGUAAGUGCCCGAAGUGUA-3'   (SEQ ID NO: 1264)
              3'-CUAUCCGAACAUUCACGGGCUUCACAU-5' (SEQ ID NO: 544)
MET-3208 Target: 5'-GATAGGCTTGTAAGTGCCCGAAGTGTA-3' (SEQ ID NO: 904)

5'-AGGCUUGUAAGUGCCCGAAGUGUAA-3'   (SEQ ID NO: 1265)
              3'-UAUCCGAACAUUCACGGGCUUCACAUU-5' (SEQ ID NO: 545)
MET-3209 Target: 5'-ATAGGCTTGTAAGTGCCCGAAGTGTAA-3' (SEQ ID NO: 905)

5'-GGCUUGUAAGUGCCCGAAGUGUAAG-3'   (SEQ ID NO: 1266)
              3'-AUCCGAACAUUCACGGGCUUCACAUUC-5' (SEQ ID NO: 546)
MET-3210 Target: 5'-TAGGCTTGTAAGTGCCCGAAGTGTAAG-3' (SEQ ID NO: 906)

5'-GCUUGUAAGUGCCCGAAGUGUAAGC-3'   (SEQ ID NO: 1267)
              3'-UCCGAACAUUCACGGGCUUCACAUUCG-5' (SEQ ID NO: 547)
MET-3211 Target: 5'-AGGCTTGTAAGTGCCCGAAGTGTAAGC-3' (SEQ ID NO: 907)

5'-CUUGUAAGUGCCCGAAGUGUAAGCC-3'   (SEQ ID NO: 1268)
              3'-CCGAACAUUCACGGGCUUCACAUUCGG-5' (SEQ ID NO: 548)
MET-3212 Target: 5'-GGCTTGTAAGTGCCCGAAGTGTAAGCC-3' (SEQ ID NO: 908)

5'-UUGUAAGUGCCCGAAGUGUAAGCCC-3'   (SEQ ID NO: 1269)
              3'-CGAACAUUCACGGGCUUCACAUUCGGG-5' (SEQ ID NO: 549)
MET-3213 Target: 5'-GCTTGTAAGTGCCCGAAGTGTAAGCCC-3' (SEQ ID NO: 909)

5'-UGUAAGUGCCCGAAGUGUAAGCCCA-3'   (SEQ ID NO: 1270)
              3'-GAACAUUCACGGGCUUCACAUUCGGGU-5' (SEQ ID NO: 550)
MET-3214 Target: 5'-CTTGTAAGTGCCCGAAGTGTAAGCCCA-3' (SEQ ID NO: 910)

5'-GUAAGUGCCCGAAGUGUAAGCCCAA-3'   (SEQ ID NO: 1271)
              3'-AACAUUCACGGGCUUCACAUUCGGGUU-5' (SEQ ID NO: 551)
MET-3215 Target: 5'-TTGTAAGTGCCCGAAGTGTAAGCCCAA-3' (SEQ ID NO: 911)

5'-UAAGUGCCCGAAGUGUAAGCCCAAC-3'   (SEQ ID NO: 1272)
              3'-ACAUUCACGGGCUUCACAUUCGGGUUG-5' (SEQ ID NO: 552)
MET-3216 Target: 5'-TGTAAGTGCCCGAAGTGTAAGCCCAAC-3' (SEQ ID NO: 912)

5'-GAGCUACUUUUCCAGAAGAUCAGUU-3'   (SEQ ID NO: 1273)
              3'-GGCUCGAUGAAAAGGUCUUCUAGUCAA-5' (SEQ ID NO: 553)
MET-3276 Target: 5'-CCGAGCTACTTTTCCAGAAGATCAGTT-3' (SEQ ID NO: 913)

5'-CACAUUGACCUCAGUGCUCUAAAUC-3'   (SEQ ID NO: 1274)
              3'-AGGUGUAACUGGAGUCACGAGAUUUAG-5' (SEQ ID NO: 554)
MET-3419 Target: 5'-TCCACATTGACCTCAGTGCTCTAAATC-3' (SEQ ID NO: 914)

5'-ACAUUGACCUCAGUGCUCUAAAUCC-3'   (SEQ ID NO: 1275)
              3'-GGUGUAACUGGAGUCACGAGAUUUAGG-5' (SEQ ID NO: 555)
MET-3420 Target: 5'-CCACATTGACCTCAGTGCTCTAAATCC-3' (SEQ ID NO: 915)

5'-CAUUGACCUCAGUGCUCUAAAUCCA-3'   (SEQ ID NO: 1276)
              3'-GUGUAACUGGAGUCACGAGAUUUAGGU-5' (SEQ ID NO: 556)
MET-3421 Target: 5'-CACATTGACCTCAGTGCTCTAAATCCA-3' (SEQ ID NO: 916)

5'-AUUGACCUCAGUGCUCUAAAUCCAG-3'   (SEQ ID NO: 1277)
              3'-UGUAACUGGAGUCACGAGAUUUAGGUC-5' (SEQ ID NO: 557)
MET-3422 Target: 5'-ACATTGACCTCAGTGCTCTAAATCCAG-3' (SEQ ID NO: 917)

5'-UUGACCUCAGUGCUCUAAAUCCAGA-3'   (SEQ ID NO: 1278)
              3'-GUAACUGGAGUCACGAGAUUUAGGUCU-5' (SEQ ID NO: 558)
MET-3423 Target: 5'-CATTGACCTCAGTGCTCTAAATCCAGA-3' (SEQ ID NO: 918)

5'-UGACCUCAGUGCUCUAAAUCCAGAG-3'   (SEQ ID NO: 1279)
              3'-UAACUGGAGUCACGAGAUUUAGGUCUC-5' (SEQ ID NO: 559)
MET-3424 Target: 5'-ATTGACCTCAGTGCTCTAAATCCAGAG-3' (SEQ ID NO: 919)
```

TABLE 3-continued

Selected Human Anti-MET DsiRNAs, Unmodified Duplexes (Asymmetrics)

```
              5'-GACCUCAGUGCUCUAAAUCCAGAGC-3'   (SEQ ID NO: 1280)
              3'-AACUGGAGUCACGAGAUUUAGGUCUCG-5' (SEQ ID NO: 560)
MET-3425 Target: 5'-TTGACCTCAGTGCTCTAAATCCAGAGC-3' (SEQ ID NO: 920)

5'-ACCUCAGUGCUCUAAAUCCAGAGCU-3'   (SEQ ID NO: 1281)
              3'-ACUGGAGUCACGAGAUUUAGGUCUCGA-5' (SEQ ID NO: 561)
MET-3426 Target: 5'-TGACCTCAGTGCTCTAAATCCAGAGCT-3' (SEQ ID NO: 921)

5'-CCUCAGUGCUCUAAAUCCAGAGCUG-3'   (SEQ ID NO: 1282)
              3'-CUGGAGUCACGAGAUUUAGGUCUCGAC-5' (SEQ ID NO: 562)
MET-3427 Target: 5'-GACCTCAGTGCTCTAAATCCAGAGCTG-3' (SEQ ID NO: 922)

5'-CUCAGUGCUCUAAAUCCAGAGCUGG-3'   (SEQ ID NO: 1283)
              3'-UGGAGUCACGAGAUUUAGGUCUCGACC-5' (SEQ ID NO: 563)
MET-3428 Target: 5'-ACCTCAGTGCTCTAAATCCAGAGCTGG-3' (SEQ ID NO: 923)

5'-UCAGUGCUCUAAAUCCAGAGCUGGU-3'   (SEQ ID NO: 1284)
              3'-GGAGUCACGAGAUUUAGGUCUCGACCA-5' (SEQ ID NO: 564)
MET-3429 Target: 5'-CCTCAGTGCTCTAAATCCAGAGCTGGT-3' (SEQ ID NO: 924)

5'-CAGUGCUCUAAAUCCAGAGCUGGUC-3'   (SEQ ID NO: 1285)
              3'-GAGUCACGAGAUUUAGGUCUCGACCAG-5' (SEQ ID NO: 565)
MET-3430 Target: 5'-CTCAGTGCTCTAAATCCAGAGCTGGTC-3' (SEQ ID NO: 925)

5'-AGUGCUCUAAAUCCAGAGCUGGUCC-3'   (SEQ ID NO: 1286)
              3'-AGUCACGAGAUUUAGGUCUCGACCAGG-5' (SEQ ID NO: 566)
MET-3431 Target: 5'-TCAGTGCTCTAAATCCAGAGCTGGTCC-3' (SEQ ID NO: 926)

5'-GUGCUCUAAAUCCAGAGCUGGUCCA-3'   (SEQ ID NO: 1287)
              3'-GUCACGAGAUUUAGGUCUCGACCAGGU-5' (SEQ ID NO: 567)
MET-3432 Target: 5'-CAGTGCTCTAAATCCAGAGCTGGTCCA-3' (SEQ ID NO: 927)

5'-UGCUCUAAAUCCAGAGCUGGUCCAG-3'   (SEQ ID NO: 1288)
              3'-UCACGAGAUUUAGGUCUCGACCAGGUC-5' (SEQ ID NO: 568)
MET-3433 Target: 5'-AGTGCTCTAAATCCAGAGCTGGTCCAG-3' (SEQ ID NO: 928)

5'-GCUCUAAAUCCAGAGCUGGUCCAGG-3'   (SEQ ID NO: 1289)
              3'-CACGAGAUUUAGGUCUCGACCAGGUCC-5' (SEQ ID NO: 569)
MET-3434 Target: 5'-GTGCTCTAAATCCAGAGCTGGTCCAGG-3' (SEQ ID NO: 929)

5'-CUCUAAAUCCAGAGCUGGUCCAGGC-3'   (SEQ ID NO: 1290)
              3'-ACGAGAUUUAGGUCUCGACCAGGUCCG-5' (SEQ ID NO: 570)
MET-3435 Target: 5'-TGCTCTAAATCCAGAGCTGGTCCAGGC-3' (SEQ ID NO: 930)

5'-UCUAAAUCCAGAGCUGGUCCAGGCA-3'   (SEQ ID NO: 1291)
              3'-CGAGAUUUAGGUCUCGACCAGGUCCGU-5' (SEQ ID NO: 571)
MET-3436 Target: 5'-GCTCTAAATCCAGAGCTGGTCCAGGCA-3' (SEQ ID NO: 931)

5'-CUAAAUCCAGAGCUGGUCCAGGCAG-3'   (SEQ ID NO: 1292)
              3'-GAGAUUUAGGUCUCGACCAGGUCCGUC-5' (SEQ ID NO: 572)
MET-3437 Target: 5'-CTCTAAATCCAGAGCTGGTCCAGGCAG-3' (SEQ ID NO: 932)

5'-UAAAUCCAGAGCUGGUCCAGGCAGU-3'   (SEQ ID NO: 1293)
              3'-AGAUUUAGGUCUCGACCAGGUCCGUCA-5' (SEQ ID NO: 573)
MET-3438 Target: 5'-TCTAAATCCAGAGCTGGTCCAGGCAGT-3' (SEQ ID NO: 933)

5'-AGCCUGAUUGUGCAUUUCAAUGAAG-3'   (SEQ ID NO: 1294)
              3'-CAUCGGACUAACACGUAAAGUUACUUC-5' (SEQ ID NO: 574)
MET-3488 Target: 5'-GTAGCCTGATTGTGCATTTCAATGAAG-3' (SEQ ID NO: 934)

5'-GCCUGAUUGUGCAUUUCAAUGAAGU-3'   (SEQ ID NO: 1295)
              3'-AUCGGACUAACACGUAAAGUUACUUCA-5' (SEQ ID NO: 575)
MET-3489 Target: 5'-TAGCCTGATTGTGCATTTCAATGAAGT-3' (SEQ ID NO: 935)

5'-CCUGAUUGUGCAUUUCAAUGAAGUC-3'   (SEQ ID NO: 1296)
              3'-UCGGACUAACACGUAAAGUUACUUCAG-5' (SEQ ID NO: 576)
MET-3490 Target: 5'-AGCCTGATTGTGCATTTCAATGAAGTC-3' (SEQ ID NO: 936)

5'-CUGAUUGUGCAUUUCAAUGAAGUCA-3'   (SEQ ID NO: 1297)
              3'-CGGACUAACACGUAAAGUUACUUCAGU-5' (SEQ ID NO: 577)
MET-3491 Target: 5'-GCCTGATTGTGCATTTCAATGAAGTCA-3' (SEQ ID NO: 937)

5'-UGAUUGUGCAUUUCAAUGAAGUCAU-3'   (SEQ ID NO: 1298)
              3'-GGACUAACACGUAAAGUUACUUCAGUA-5' (SEQ ID NO: 578)
MET-3492 Target: 5'-CCTGATTGTGCATTTCAATGAAGTCAT-3' (SEQ ID NO: 938)
```

TABLE 3-continued

Selected Human Anti-MET DsiRNAs, Unmodified Duplexes (Asymmetrics)

```
              5'-GAUUGUGCAUUUCAAUGAAGUCAUA-3'    (SEQ ID NO: 1299)
              3'-GACUAACACGUAAAGUUACUUCAGUAU-5'  (SEQ ID NO: 579)
MET-3493 Target: 5'-CTGATTGTGCATTTCAATGAAGTCATA-3' (SEQ ID NO: 939)

5'-AUUGUGCAUUUCAAUGAAGUCAUAG-3'    (SEQ ID NO: 1300)
              3'-ACUAACACGUAAAGUUACUUCAGUAUC-5'  (SEQ ID NO: 580)
MET-3494 Target: 5'-TGATTGTGCATTTCAATGAAGTCATAG-3' (SEQ ID NO: 940)

5'-UUGUGCAUUUCAAUGAAGUCAUAGG-3'    (SEQ ID NO: 1301)
              3'-CUAACACGUAAAGUUACUUCAGUAUCC-5'  (SEQ ID NO: 581)
MET-3495 Target: 5'-GATTGTGCATTTCAATGAAGTCATAGG-3' (SEQ ID NO: 941)

5'-UGUGCAUUUCAAUGAAGUCAUAGGA-3'    (SEQ ID NO: 1302)
              3'-UAACACGUAAAGUUACUUCAGUAUCCU-5'  (SEQ ID NO: 582)
MET-3496 Target: 5'-ATTGTGCATTTCAATGAAGTCATAGGA-3' (SEQ ID NO: 942)

5'-GUGCAUUUCAAUGAAGUCAUAGGAA-3'    (SEQ ID NO: 1303)
              3'-AACACGUAAAGUUACUUCAGUAUCCUU-5'  (SEQ ID NO: 583)
MET-3497 Target: 5'-TTGTGCATTTCAATGAAGTCATAGGAA-3' (SEQ ID NO: 943)

5'-UGCAUUUCAAUGAAGUCAUAGGAAG-3'    (SEQ ID NO: 1304)
              3'-ACACGUAAAGUUACUUCAGUAUCCUUC-5'  (SEQ ID NO: 584)
MET-3498 Target: 5'-TGTGCATTTCAATGAAGTCATAGGAAG-3' (SEQ ID NO: 944)

5'-GCAUUUCAAUGAAGUCAUAGGAAGA-3'    (SEQ ID NO: 1305)
              3'-CACGUAAAGUUACUUCAGUAUCCUUCU-5'  (SEQ ID NO: 585)
MET-3499 Target: 5'-GTGCATTTCAATGAAGTCATAGGAAGA-3' (SEQ ID NO: 945)

5'-CAUUUCAAUGAAGUCAUAGGAAGAG-3'    (SEQ ID NO: 1306)
              3'-ACGUAAAGUUACUUCAGUAUCCUUCUC-5'  (SEQ ID NO: 586)
MET-3500 Target: 5'-TGCATTTCAATGAAGTCATAGGAAGAG-3' (SEQ ID NO: 946)

5'-AUUUCAAUGAAGUCAUAGGAAGAGG-3'    (SEQ ID NO: 1307)
              3'-CGUAAAGUUACUUCAGUAUCCUUCUCC-5'  (SEQ ID NO: 587)
MET-3501 Target: 5'-GCATTTCAATGAAGTCATAGGAAGAGG-3' (SEQ ID NO: 947)

5'-UUUCAAUGAAGUCAUAGGAAGAGGG-3'    (SEQ ID NO: 1308)
              3'-GUAAAGUUACUUCAGUAUCCUUCUCCC-5'  (SEQ ID NO: 588)
MET-3502 Target: 5'-CATTTCAATGAAGTCATAGGAAGAGGG-3' (SEQ ID NO: 948)

5'-UUCAAUGAAGUCAUAGGAAGAGGGC-3'    (SEQ ID NO: 1309)
              3'-UAAAGUUACUUCAGUAUCCUUCUCCCG-5'  (SEQ ID NO: 589)
MET-3503 Target: 5'-ATTTCAATGAAGTCATAGGAAGAGGGC-3' (SEQ ID NO: 949)

5'-UCAAUGAAGUCAUAGGAAGAGGGCA-3'    (SEQ ID NO: 1310)
              3'-AAAGUUACUUCAGUAUCCUUCUCCCGU-5'  (SEQ ID NO: 590)
MET-3504 Target: 5'-TTTCAATGAAGTCATAGGAAGAGGGCA-3' (SEQ ID NO: 950)

5'-CAAUGAAGUCAUAGGAAGAGGGCAU-3'    (SEQ ID NO: 1311)
              3'-AAGUUACUUCAGUAUCCUUCUCCCGUA-5'  (SEQ ID NO: 591)
MET-3505 Target: 5'-TTCAATGAAGTCATAGGAAGAGGGCAT-3' (SEQ ID NO: 951)

5'-AAUGAAGUCAUAGGAAGAGGGCAUU-3'    (SEQ ID NO: 1312)
              3'-AGUUACUUCAGUAUCCUUCUCCCGUAA-5'  (SEQ ID NO: 592)
MET-3506 Target: 5'-TCAATGAAGTCATAGGAAGAGGGCATT-3' (SEQ ID NO: 952)

5'-AUGAAGUCAUAGGAAGAGGGCAUUU-3'    (SEQ ID NO: 1313)
              3'-GUUACUUCAGUAUCCUUCUCCCGUAAA-5'  (SEQ ID NO: 593)
MET-3507 Target: 5'-CAATGAAGTCATAGGAAGAGGGCATTT-3' (SEQ ID NO: 953)

5'-UGAAGUCAUAGGAAGAGGGCAUUUU-3'    (SEQ ID NO: 1314)
              3'-UUACUUCAGUAUCCUUCUCCCGUAAAA-5'  (SEQ ID NO: 594)
MET-3508 Target: 5'-AATGAAGTCATAGGAAGAGGGCATTTT-3' (SEQ ID NO: 954)

5'-GAAGUCAUAGGAAGAGGGCAUUUUG-3'    (SEQ ID NO: 1315)
              3'-UACUUCAGUAUCCUUCUCCCGUAAAAC-5'  (SEQ ID NO: 595)
MET-3509 Target: 5'-ATGAAGTCATAGGAAGAGGGCATTTTG-3' (SEQ ID NO: 955)

5'-AAGUCAUAGGAAGAGGGCAUUUUGG-3'    (SEQ ID NO: 1316)
              3'-ACUUCAGUAUCCUUCUCCCGUAAAACC-5'  (SEQ ID NO: 596)
MET-3510 Target: 5'-TGAAGTCATAGGAAGAGGGCATTTTGG-3' (SEQ ID NO: 956)

5'-AGUCAUAGGAAGAGGGCAUUUUGGU-3'    (SEQ ID NO: 1317)
              3'-CUUCAGUAUCCUUCUCCCGUAAAACCA-5'  (SEQ ID NO: 597)
MET-3511 Target: 5'-GAAGTCATAGGAAGAGGGCATTTTGGT-3' (SEQ ID NO: 957)
```

TABLE 3-continued

Selected Human Anti-MET DsiRNAs, Unmodified Duplexes (Asymmetrics)

```
                5'-GUCAUAGGAAGAGGGCAUUUUGGUU-3'      (SEQ ID NO: 1318)
                3'-UUCAGUAUCCUUCUCCCGUAAAACCAA-5'    (SEQ ID NO: 598)
MET-3512 Target: 5'-AAGTCATAGGAAGAGGGCATTTTGGTT-3'   (SEQ ID NO: 958)

5'-UCAUAGGAAGAGGGCAUUUUGGUUG-3'      (SEQ ID NO: 1319)
                3'-UCAGUAUCCUUCUCCCGUAAAACCAAC-5'    (SEQ ID NO: 599)
MET-3513 Target: 5'-AGTCATAGGAAGAGGGCATTTTGGTTG-3'   (SEQ ID NO: 959)

5'-CAUAGGAAGAGGGCAUUUUGGUUGU-3'      (SEQ ID NO: 1320)
                3'-CAGUAUCCUUCUCCCGUAAAACCAACA-5'    (SEQ ID NO: 600)
MET-3514 Target: 5'-GTCATAGGAAGAGGGCATTTTGGTTGT-3'   (SEQ ID NO: 960)

5'-AUAGGAAGAGGGCAUUUUGGUUGUG-3'      (SEQ ID NO: 1321)
                3'-AGUAUCCUUCUCCCGUAAAACCAACAC-5'    (SEQ ID NO: 601)
MET-3515 Target: 5'-TCATAGGAAGAGGGCATTTTGGTTGTG-3'   (SEQ ID NO: 961)

5'-AAGAAAAUUCACUGUGCUGUGAAAU-3'      (SEQ ID NO: 1322)
                3'-CGUUCUUUUAAGUGACACGACACUUUA-5'    (SEQ ID NO: 602)
MET-3572 Target: 5'-GCAAGAAAATTCACTGTGCTGTGAAAT-3'   (SEQ ID NO: 962)

5'-AGAAAAUUCACUGUGCUGUGAAAUC-3'      (SEQ ID NO: 1323)
                3'-GUUCUUUUAAGUGACACGACACUUUAG-5'    (SEQ ID NO: 603)
MET-3573 Target: 5'-CAAGAAAATTCACTGTGCTGTGAAATC-3'   (SEQ ID NO: 963)

5'-GAAAAUUCACUGUGCUGUGAAAUCC-3'      (SEQ ID NO: 1324)
                3'-UUCUUUUAAGUGACACGACACUUUAGG-5'    (SEQ ID NO: 604)
MET-3574 Target: 5'-AAGAAAATTCACTGTGCTGTGAAATCC-3'   (SEQ ID NO: 964)

5'-AAAAUUCACUGUGCUGUGAAAUCCU-3'      (SEQ ID NO: 1325)
                3'-UCUUUUAAGUGACACGACACUUUAGGA-5'    (SEQ ID NO: 605)
MET-3575 Target: 5'-AGAAAATTCACTGTGCTGTGAAATCCT-3'   (SEQ ID NO: 965)

5'-AAAUUCACUGUGCUGUGAAAUCCUU-3'      (SEQ ID NO: 1326)
                3'-CUUUUAAGUGACACGACACUUUAGGAA-5'    (SEQ ID NO: 606)
MET-3576 Target: 5'-GAAAATTCACTGTGCTGTGAAATCCTT-3'   (SEQ ID NO: 966)

5'-AAUUCACUGUGCUGUGAAAUCCUUG-3'      (SEQ ID NO: 1327)
                3'-UUUUAAGUGACACGACACUUUAGGAAC-5'    (SEQ ID NO: 607)
MET-3577 Target: 5'-AAAATTCACTGTGCTGTGAAATCCTTG-3'   (SEQ ID NO: 967)

5'-AUUCACUGUGCUGUGAAAUCCUUGA-3'      (SEQ ID NO: 1328)
                3'-UUUAAGUGACACGACACUUUAGGAACU-5'    (SEQ ID NO: 608)
MET-3578 Target: 5'-AAATTCACTGTGCTGTGAAATCCTTGA-3'   (SEQ ID NO: 968)

5'-UUCACUGUGCUGUGAAAUCCUUGAA-3'      (SEQ ID NO: 1329)
                3'-UUAAGUGACACGACACUUUAGGAACUU-5'    (SEQ ID NO: 609)
MET-3579 Target: 5'-AATTCACTGTGCTGTGAAATCCTTGAA-3'   (SEQ ID NO: 969)

5'-UCACUGUGCUGUGAAAUCCUUGAAC-3'      (SEQ ID NO: 1330)
                3'-UAAGUGACACGACACUUUAGGAACUUG-5'    (SEQ ID NO: 610)
MET-3580 Target: 5'-ATTCACTGTGCTGTGAAATCCTTGAAC-3'   (SEQ ID NO: 970)

5'-CACUGUGCUGUGAAAUCCUUGAACA-3'      (SEQ ID NO: 1331)
                3'-AAGUGACACGACACUUUAGGAACUUGU-5'    (SEQ ID NO: 611)
MET-3581 Target: 5'-TTCACTGTGCTGTGAAATCCTTGAACA-3'   (SEQ ID NO: 971)

5'-ACUGUGCUGUGAAAUCCUUGAACAG-3'      (SEQ ID NO: 1332)
                3'-AGUGACACGACACUUUAGGAACUUGUC-5'    (SEQ ID NO: 612)
MET-3582 Target: 5'-TCACTGTGCTGTGAAATCCTTGAACAG-3'   (SEQ ID NO: 972)

5'-GAGGGAAUCAUCAUGAAAGAUUUUA-3'      (SEQ ID NO: 1333)
                3'-GGCUCCCUUAGUAGUACUUUCUAAAAU-5'    (SEQ ID NO: 613)
MET-3644 Target: 5'-CCGAGGGAATCATCATGAAAGATTTTA-3'   (SEQ ID NO: 973)

5'-AGGGAAUCAUCAUGAAAGAUUUUAG-3'      (SEQ ID NO: 1334)
                3'-GCUCCCUUAGUAGUACUUUCUAAAAUC-5'    (SEQ ID NO: 614)
MET-3645 Target: 5'-CGAGGGAATCATCATGAAAGATTTTAG-3'   (SEQ ID NO: 974)

5'-GAGACUCAUAAUCCAACUGUAAAAG-3'      (SEQ ID NO: 1335)
                3'-UACUCUGAGUAUUAGGUUGACAUUUUC-5'    (SEQ ID NO: 615)
MET-3779 Target: 5'-ATGAGACTCATAATCCAACTGTAAAAG-3'   (SEQ ID NO: 975)

5'-AGACUCAUAAUCCAACUGUAAAAGA-3'      (SEQ ID NO: 1336)
                3'-ACUCUGAGUAUUAGGUUGACAUUUUCU-5'    (SEQ ID NO: 616)
MET-3780 Target: 5'-TGAGACTCATAATCCAACTGTAAAAGA-3'   (SEQ ID NO: 976)
```

TABLE 3-continued

Selected Human Anti-MET DsiRNAs, Unmodified Duplexes (Asymmetrics)

|  |  |  |
|---|---|---|
| MET-3795 Target: | 5'-CUGUAAAAGAUCUUAUUGGCUUUGG-3'<br>3'-UUGACAUUUUCUAGAAUAACCGAAACC-5'<br>5'-AACTGTAAAAGATCTTATTGGCTTTGG-3' | (SEQ ID NO: 1337)<br>(SEQ ID NO: 617)<br>(SEQ ID NO: 977) |
| MET-3812 Target: | 5'-GGCUUUGGUCUUCAAGUAGCCAAAG-3'<br>3'-AACCGAAACCAGAAGUUCAUCGGUUUC-5'<br>5'-TTGGCTTTGGTCTTCAAGTAGCCAAAG-3' | (SEQ ID NO: 1338)<br>(SEQ ID NO: 618)<br>(SEQ ID NO: 978) |
| MET-3821 Target: | 5'-CUUCAAGUAGCCAAAGGCAUGAAAU-3'<br>3'-CAGAAGUUCAUCGGUUUCCGUACUUUA-5'<br>5'-GTCTTCAAGTAGCCAAAGGCATGAAAT-3' | (SEQ ID NO: 1339)<br>(SEQ ID NO: 619)<br>(SEQ ID NO: 979) |
| MET-3822 Target: | 5'-UUCAAGUAGCCAAAGGCAUGAAAUA-3'<br>3'-AGAAGUUCAUCGGUUUCCGUACUUUAU-5'<br>5'-TCTTCAAGTAGCCAAAGGCATGAAATA-3' | (SEQ ID NO: 1340)<br>(SEQ ID NO: 620)<br>(SEQ ID NO: 980) |
| MET-3823 Target: | 5'-UCAAGUAGCCAAAGGCAUGAAAUAU-3'<br>3'-GAAGUUCAUCGGUUUCCGUACUUUAUA-5'<br>5'-CTTCAAGTAGCCAAAGGCATGAAATAT-3' | (SEQ ID NO: 1341)<br>(SEQ ID NO: 621)<br>(SEQ ID NO: 981) |
| MET-3824 Target: | 5'-CAAGUAGCCAAAGGCAUGAAAUAUC-3'<br>3'-AAGUUCAUCGGUUUCCGUACUUUAUAG-5'<br>5'-TTCAAGTAGCCAAAGGCATGAAATATC-3' | (SEQ ID NO: 1342)<br>(SEQ ID NO: 622)<br>(SEQ ID NO: 982) |
| MET-3825 Target: | 5'-AAGUAGCCAAAGGCAUGAAAUAUCU-3'<br>3'-AGUUCAUCGGUUUCCGUACUUUAUAGA-5'<br>5'-TCAAGTAGCCAAAGGCATGAAATATCT-3' | (SEQ ID NO: 1343)<br>(SEQ ID NO: 623)<br>(SEQ ID NO: 983) |
| MET-3826 Target: | 5'-AGUAGCCAAAGGCAUGAAAUAUCUU-3'<br>3'-GUUCAUCGGUUUCCGUACUUUAUAGAA-5'<br>5'-CAAGTAGCCAAAGGCATGAAATATCTT-3' | (SEQ ID NO: 1344)<br>(SEQ ID NO: 624)<br>(SEQ ID NO: 984) |
| MET-3827 Target: | 5'-GUAGCCAAAGGCAUGAAAUAUCUUG-3'<br>3'-UUCAUCGGUUUCCGUACUUUAUAGAAC-5'<br>5'-AAGTAGCCAAAGGCATGAAATATCTTG-3' | (SEQ ID NO: 1345)<br>(SEQ ID NO: 625)<br>(SEQ ID NO: 985) |
| MET-3828 Target: | 5'-UAGCCAAAGGCAUGAAAUAUCUUGC-3'<br>3'-UCAUCGGUUUCCGUACUUUAUAGAACG-5'<br>5'-AGTAGCCAAAGGCATGAAATATCTTGC-3' | (SEQ ID NO: 1346)<br>(SEQ ID NO: 626)<br>(SEQ ID NO: 986) |
| MET-3829 Target: | 5'-AGCCAAAGGCAUGAAAUAUCUUGCA-3'<br>3'-CAUCGGUUUCCGUACUUUAUAGAACGU-5'<br>5'-GTAGCCAAAGGCATGAAATATCTTGCA-3' | (SEQ ID NO: 1347)<br>(SEQ ID NO: 627)<br>(SEQ ID NO: 987) |
| MET-3830 Target: | 5'-GCCAAAGGCAUGAAAUAUCUUGCAA-3'<br>3'-AUCGGUUUCCGUACUUUAUAGAACGUU-5'<br>5'-TAGCCAAAGGCATGAAATATCTTGCAA-3' | (SEQ ID NO: 1348)<br>(SEQ ID NO: 628)<br>(SEQ ID NO: 988) |
| MET-3831 Target: | 5'-CCAAAGGCAUGAAAUAUCUUGCAAG-3'<br>3'-UCGGUUUCCGUACUUUAUAGAACGUUC-5'<br>5'-AGCCAAAGGCATGAAATATCTTGCAAG-3' | (SEQ ID NO: 1349)<br>(SEQ ID NO: 629)<br>(SEQ ID NO: 989) |
| MET-3832 Target: | 5'-CAAAGGCAUGAAAUAUCUUGCAAGC-3'<br>3'-CGGUUUCCGUACUUUAUAGAACGUUCG-5'<br>5'-GCCAAAGGCATGAAATATCTTGCAAGC-3' | (SEQ ID NO: 1350)<br>(SEQ ID NO: 630)<br>(SEQ ID NO: 990) |
| MET-3833 Target: | 5'-AAAGGCAUGAAAUAUCUUGCAAGCA-3'<br>3'-GGUUUCCGUACUUUAUAGAACGUUCGU-5'<br>5'-CCAAAGGCATGAAATATCTTGCAAGCA-3' | (SEQ ID NO: 1351)<br>(SEQ ID NO: 631)<br>(SEQ ID NO: 991) |
| MET-3834 Target: | 5'-AAGGCAUGAAAUAUCUUGCAAGCAA-3'<br>3'-GUUUCCGUACUUUAUAGAACGUUCGUU-5'<br>5'-CAAAGGCATGAAATATCTTGCAAGCAA-3' | (SEQ ID NO: 1352)<br>(SEQ ID NO: 632)<br>(SEQ ID NO: 992) |
| MET-3854 Target: | 5'-AGCAAAAAGUUUGUCCACAGAGACU-3'<br>3'-GUUCGUUUUUCAAACAGGUGUCUCUGA-5'<br>5'-CAAGCAAAAAGTTTGTCCACAGAGACT-3' | (SEQ ID NO: 1353)<br>(SEQ ID NO: 633)<br>(SEQ ID NO: 993) |
| MET-3855 Target: | 5'-GCAAAAAGUUUGUCCACAGAGACUU-3'<br>3'-UUCGUUUUUCAAACAGGUGUCUCUGAA-5'<br>5'-AAGCAAAAAGTTTGTCCACAGAGACTT-3' | (SEQ ID NO: 1354)<br>(SEQ ID NO: 634)<br>(SEQ ID NO: 994) |
| MET-3856 Target: | 5'-CAAAAAGUUUGUCCACAGAGACUUG-3'<br>3'-UCGUUUUUCAAACAGGUGUCUCUGAAC-5'<br>5'-AGCAAAAAGTTTGTCCACAGAGACTTG-3' | (SEQ ID NO: 1355)<br>(SEQ ID NO: 635)<br>(SEQ ID NO: 995) |

TABLE 3-continued

Selected Human Anti-MET DsiRNAs, Unmodified Duplexes (Asymmetrics)

```
                  5'-AAAAAGUUUGUCCACAGAGACUUGG-3'    (SEQ ID NO: 1356)
                  3'-CGUUUUUCAAACAGGUGUCUCUGAACC-5'  (SEQ ID NO:  636)
MET-3857 Target:  5'-GCAAAAAGTTTGTCCACAGAGACTTGG-3'  (SEQ ID NO:  996)

5'-AAAAGUUUGUCCACAGAGACUUGGC-3'    (SEQ ID NO: 1357)
                  3'-GUUUUUCAAACAGGUGUCUCUGAACCG-5'  (SEQ ID NO:  637)
MET-3858 Target:  5'-CAAAAAGTTTGTCCACAGAGACTTGGC-3'  (SEQ ID NO:  997)

5'-AAAGUUUGUCCACAGAGACUUGGCU-3'    (SEQ ID NO: 1358)
                  3'-UUUUUCAAACAGGUGUCUCUGAACCGA-5'  (SEQ ID NO:  638)
MET-3859 Target:  5'-AAAAAGTTTGTCCACAGAGACTTGGCT-3'  (SEQ ID NO:  998)

5'-AAGUUUGUCCACAGAGACUUGGCUG-3'    (SEQ ID NO: 1359)
                  3'-UUUUCAAACAGGUGUCUCUGAACCGAC-5'  (SEQ ID NO:  639)
MET-3860 Target:  5'-AAAAGTTTGTCCACAGAGACTTGGCTG-3'  (SEQ ID NO:  999)

5'-AGUUUGUCCACAGAGACUUGGCUGC-3'    (SEQ ID NO: 1360)
                  3'-UUUCAAACAGGUGUCUCUGAACCGACG-5'  (SEQ ID NO:  640)
MET-3861 Target:  5'-AAAGTTTGTCCACAGAGACTTGGCTGC-3'  (SEQ ID NO: 1000)

5'-CUUGGCUGCAAGAAACUGUAUGCUG-3'    (SEQ ID NO: 1361)
                  3'-CUGAACCGACGUUCUUUGACAUACGAC-5'  (SEQ ID NO:  641)
MET-3877 Target:  5'-GACTTGGCTGCAAGAAACTGTATGCTG-3'  (SEQ ID NO: 1001)

5'-UGGCUGCAAGAAACUGUAUGCUGGA-3'    (SEQ ID NO: 1362)
                  3'-GAACCGACGUUCUUUGACAUACGACCU-5'  (SEQ ID NO:  642)
MET-3879 Target:  5'-CTTGGCTGCAAGAAACTGTATGCTGGA-3'  (SEQ ID NO: 1002)

5'-GGCUGCAAGAAACUGUAUGCUGGAU-3'    (SEQ ID NO: 1363)
                  3'-AACCGACGUUCUUUGACAUACGACCUA-5'  (SEQ ID NO:  643)
MET-3880 Target:  5'-TTGGCTGCAAGAAACTGTATGCTGGAT-3'  (SEQ ID NO: 1003)

5'-GCUGCAAGAAACUGUAUGCUGGAUG-3'    (SEQ ID NO: 1364)
                  3'-ACCGACGUUCUUUGACAUACGACCUAC-5'  (SEQ ID NO:  644)
MET-3881 Target:  5'-TGGCTGCAAGAAACTGTATGCTGGATG-3'  (SEQ ID NO: 1004)

5'-CUGCAAGAAACUGUAUGCUGGAUGA-3'    (SEQ ID NO: 1365)
                  3'-CCGACGUUCUUUGACAUACGACCUACU-5'  (SEQ ID NO:  645)
MET-3882 Target:  5'-GGCTGCAAGAAACTGTATGCTGGATGA-3'  (SEQ ID NO: 1005)

5'-GUCAAGGUUGCUGAUUUUGGUCUUG-3'    (SEQ ID NO: 1366)
                  3'-GUCAGUUCCAACGACUAAAACCAGAAC-5'  (SEQ ID NO:  646)
MET-3917 Target:  5'-CAGTCAAGGTTGCTGATTTTGGTCTTG-3'  (SEQ ID NO: 1006)

5'-GGUUGCUGAUUUUGGUCUUGCCAGA-3'    (SEQ ID NO: 1367)
                  3'-UUCCAACGACUAAAACCAGAACGGUCU-5'  (SEQ ID NO:  647)
MET-3922 Target:  5'-AAGGTTGCTGATTTTGGTCTTGCCAGA-3'  (SEQ ID NO: 1007)

5'-UUGCUGAUUUUGGUCUUGCCAGAGA-3'    (SEQ ID NO: 1368)
                  3'-CCAACGACUAAAACCAGAACGGUCUCU-5'  (SEQ ID NO:  648)
MET-3924 Target:  5'-GGTTGCTGATTTTGGTCTTGCCAGAGA-3'  (SEQ ID NO: 1008)

5'-GGUCUUGCCAGAGACAUGUAUGAUA-3'    (SEQ ID NO: 1369)
                  3'-AACCAGAACGGUCUCUGUACAUACUAU-5'  (SEQ ID NO:  649)
MET-3935 Target:  5'-TTGGTCTTGCCAGAGACATGTATGATA-3'  (SEQ ID NO: 1009)

5'-GUCUUGCCAGAGACAUGUAUGAUAA-3'    (SEQ ID NO: 1370)
                  3'-ACCAGAACGGUCUCUGUACAUACUAUU-5'  (SEQ ID NO:  650)
MET-3936 Target:  5'-TGGTCTTGCCAGAGACATGTATGATAA-3'  (SEQ ID NO: 1010)

5'-GCUGCCAGUGAAGUGGAUGGCUUUG-3'    (SEQ ID NO: 1371)
                  3'-UUCGACGGUCACUUCACCUACCGAAAC-5'  (SEQ ID NO:  651)
MET-3997 Target:  5'-AAGCTGCCAGTGAAGTGGATGGCTTTG-3'  (SEQ ID NO: 1011)

5'-CUGCCAGUGAAGUGGAUGGCUUUGG-3'    (SEQ ID NO: 1372)
                  3'-UCGACGGUCACUUCACCUACCGAAACC-5'  (SEQ ID NO:  652)
MET-3998 Target:  5'-AGCTGCCAGTGAAGTGGATGGCTTTGG-3'  (SEQ ID NO: 1012)

5'-GUGGAUGGCUUUGGAAAGUCUGCAA-3'    (SEQ ID NO: 1373)
                  3'-UUCACCUACCGAAACCUUUCAGACGUU-5'  (SEQ ID NO:  653)
MET-4009 Target:  5'-AAGTGGATGGCTTTGGAAAGTCTGCAA-3'  (SEQ ID NO: 1013)

5'-GGAUGGCUUUGGAAAGUCUGCAAAC-3'    (SEQ ID NO: 1374)
                  3'-CACCUACCGAAACCUUUCAGACGUUUG-5'  (SEQ ID NO:  654)
MET-4011 Target:  5'-GTGGATGGCTTTGGAAAGTCTGCAAAC-3'  (SEQ ID NO: 1014)
```

TABLE 3-continued

Selected Human Anti-MET DsiRNAs, Unmodified Duplexes (Asymmetrics)

```
                  5'-UUUGGAAAGUCUGCAAACUCAAAAG-3'    (SEQ ID NO: 1375)
                  3'-CGAAACCUUUCAGACGUUUGAGUUUUC-5'  (SEQ ID NO: 655)
MET-4018 Target:  5'-GCTTTGGAAAGTCTGCAAACTCAAAAG-3'  (SEQ ID NO: 1015)

5'-CUUUGGCGUGCUCCUCUGGGAGCUG-3'    (SEQ ID NO: 1376)
                  3'-AGGAAACCGCACGAGGAGACCCUCGAC-5'  (SEQ ID NO: 656)
MET-4069 Target:  5'-TCCTTTGGCGTGCTCCTCTGGGAGCTG-3'  (SEQ ID NO: 1016)

5'-UUGGCGUGCUCCUCUGGGAGCUGAU-3'    (SEQ ID NO: 1377)
                  3'-GAAACCGCACGAGGAGACCCUCGACUA-5'  (SEQ ID NO: 657)
MET-4071 Target:  5'-CTTTGGCGTGCTCCTCTGGGAGCTGAT-3'  (SEQ ID NO: 1017)

5'-UGGCGUGCUCCUCUGGGAGCUGAUG-3'    (SEQ ID NO: 1378)
                  3'-AAACCGCACGAGGAGACCCUCGACUAC-5'  (SEQ ID NO: 658)
MET-4072 Target:  5'-TTTGGCGTGCTCCTCTGGGAGCTGATG-3'  (SEQ ID NO: 1018)

5'-GGCGUGCUCCUCUGGGAGCUGAUGA-3'    (SEQ ID NO: 1379)
                  3'-AACCGCACGAGGAGACCCUCGACUACU-5'  (SEQ ID NO: 659)
MET-4073 Target:  5'-TTGGCGTGCTCCTCTGGGAGCTGATGA-3'  (SEQ ID NO: 1019)

5'-GCGUGCUCCUCUGGGAGCUGAUGAC-3'    (SEQ ID NO: 1380)
                  3'-ACCGCACGAGGAGACCCUCGACUACUG-5'  (SEQ ID NO: 660)
MET-4074 Target:  5'-TGGCGTGCTCCTCTGGGAGCTGATGAC-3'  (SEQ ID NO: 1020)

5'-GUGAACGCUACUUAUGUGAACGUAA-3'    (SEQ ID NO: 1381)
                  3'-UACACUUGCGAUGAAUACACUUGCAUU-5'  (SEQ ID NO: 661)
MET-4319 Target:  5'-ATGTGAACGCTACTTATGTGAACGTAA-3'  (SEQ ID NO: 1021)

5'-UGAACGCUACUUAUGUGAACGUAAA-3'    (SEQ ID NO: 1382)
                  3'-ACACUUGCGAUGAAUACACUUGCAUUU-5'  (SEQ ID NO: 662)
MET-4320 Target:  5'-TGTGAACGCTACTTATGTGAACGTAAA-3'  (SEQ ID NO: 1022)

5'-CUGUUGUCAUCAGAAGAUAACGCUG-3'    (SEQ ID NO: 1383)
                  3'-GAGACAACAGUAGUCUUCUAUUGCGAC-5'  (SEQ ID NO: 663)
MET-4367 Target:  5'-CTCTGTTGTCATCAGAAGATAACGCTG-3'  (SEQ ID NO: 1023)

5'-UUGCUCUUGCCAAAAUUGCACUAUU-3'    (SEQ ID NO: 1384)
                  3'-GAAACGAGAACGGUUUUAACGUGAUAA-5'  (SEQ ID NO: 664)
MET-4523 Target:  5'-CTTTGCTCTTGCCAAAATTGCACTATT-3'  (SEQ ID NO: 1024)

5'-AUUGUUAUUUAAAUUACUGGAUUCU-3'    (SEQ ID NO: 1385)
                  3'-CAUAACAAUAAAUUUAAUGACCUAAGA-5'  (SEQ ID NO: 665)
MET-4559 Target:  5'-GTATTGTTATTTAAATTACTGGATTCT-3'  (SEQ ID NO: 1025)

5'-CUGGAUUCUAAGGAAUUUCUUAUCU-3'    (SEQ ID NO: 1386)
                  3'-AUGACCUAAGAUUCCUUAAAGAAUAGA-5'  (SEQ ID NO: 666)
MET-4575 Target:  5'-TACTGGATTCTAAGGAATTTCTTATCT-3'  (SEQ ID NO: 1026)

5'-UGGAUUCUAAGGAAUUUCUUAUCUG-3'    (SEQ ID NO: 1387)
                  3'-UGACCUAAGAUUCCUUAAAGAAUAGAC-5'  (SEQ ID NO: 667)
MET-4576 Target:  5'-ACTGGATTCTAAGGAATTTCTTATCTG-3'  (SEQ ID NO: 1027)

5'-GGUUGAAUUUUUUAAAAAUCAGGUA-3'    (SEQ ID NO: 1388)
                  3'-ACCCAACUUAAAAAAAUUUUUAGUCCAU-5' (SEQ ID NO: 668)
MET-4703 Target:  5'-TGGGTTGAATTTTTTAAAAATCAGGTA-3'  (SEQ ID NO: 1028)

5'-AAACAUUCCCUUUUAAAUGUUUGUU-3'    (SEQ ID NO: 1389)
                  3'-CAUUUGUAAGGGAAAAUUUACAAACAA-5'  (SEQ ID NO: 669)
MET-4935 Target:  5'-GTAAACATTCCCTTTTAAATGTTTGTT-3'  (SEQ ID NO: 1029)

5'-UUAAAUGUUUGUUUGUUUUUGAGA-3'     (SEQ ID NO: 1390)
                  3'-AAAAUUUACAAACAAACAAAAACUCU-5'   (SEQ ID NO: 670)
MET-4947 Target:  5'-TTTTAAATGTTTGTTTGTTTTTGAGA-3'   (SEQ ID NO: 1030)

5'-GGAUCUCACUCUGUUGCCAGGGCUG-3'    (SEQ ID NO: 1391)
                  3'-GUCCUAGAGUGAGACAACGGUCCCGAC-5'  (SEQ ID NO: 671)
MET-4974 Target:  5'-CAGGATCTCACTCTGTTGCCAGGGCTG-3'  (SEQ ID NO: 1031)

5'-AUCUCACUCUGUUGCCAGGGCUGUA-3'    (SEQ ID NO: 1392)
                  3'-CCUAGAGUGAGACAACGGUCCCGACAU-5'  (SEQ ID NO: 672)
MET-4976 Target:  5'-GGATCTCACTCTGTTGCCAGGGCTGTA-3'  (SEQ ID NO: 1032)

5'-CACUCUGUUGCCAGGGCUGUAGUGC-3'    (SEQ ID NO: 1393)
                  3'-GAGUGAGACAACGGUCCCGACAUCACG-5'  (SEQ ID NO: 673)
MET-4980 Target:  5'-CTCACTCTGTTGCCAGGGCTGTAGTGC-3'  (SEQ ID NO: 1033)
```

TABLE 3-continued

Selected Human Anti-MET DsiRNAs, Unmodified Duplexes (Asymmetrics)

```
                 5'-CUCUGUUGCCAGGGCUGUAGUGCAG-3'       (SEQ ID NO: 1394)
                 3'-GUGAGACAACGGUCCCGACAUCACGUC-5'     (SEQ ID NO:  674)
MET-4982 Target: 5'-CACTCTGTTGCCAGGGCTGTAGTGCAG-3'     (SEQ ID NO: 1034)

5'-GUUGCCAGGGCUGUAGUGCAGUGGU-3'       (SEQ ID NO: 1395)
                 3'-GACAACGGUCCCGACAUCACGUCACCA-5'     (SEQ ID NO:  675)
MET-4986 Target: 5'-CTGTTGCCAGGGCTGTAGTGCAGTGGT-3'     (SEQ ID NO: 1035)

5'-CUGUAGUGCAGUGGUGUGAUCAUAG-3'       (SEQ ID NO: 1396)
                 3'-CCGACAUCACGUCACCACACUAGUAUC-5'     (SEQ ID NO:  676)
MET-4996 Target: 5'-GGCTGTAGTGCAGTGGTGTGATCATAG-3'     (SEQ ID NO: 1036)

5'-GCAGUGGUGUGAUCAUAGCUCACUG-3'       (SEQ ID NO: 1397)
                 3'-CACGUCACCACACUAGUAUCGAGUGAC-5'     (SEQ ID NO:  677)
MET-5003 Target: 5'-GTGCAGTGGTGTGATCATAGCTCACTG-3'     (SEQ ID NO: 1037)

5'-GGCUAAUUUUUGUAUUUUUUGUAGA-3'       (SEQ ID NO: 1398)
                 3'-GGCCGAUUAAAAACAUAAAAAACAUCU-5'     (SEQ ID NO:  678)
MET-5094 Target: 5'-CCGGCTAATTTTTGTATTTTTTGTAGA-3'     (SEQ ID NO: 1038)

5'-UUAUAAAUUUUUGUAUAGACAUUCC-3'       (SEQ ID NO: 1399)
                 3'-GGAAUAUUUAAAAACAUAUCUGUAAGG-5'     (SEQ ID NO:  679)
MET-5234 Target: 5'-CCTTATAAATTTTTGTATAGACATTCC-3'     (SEQ ID NO: 1039)

5'-UGGAAGAAUAUUUAUAGGCAAUACA-3'       (SEQ ID NO: 1400)
                 3'-CAACCUUCUUAUAAAUAUCCGUUAUGU-5'     (SEQ ID NO:  680)
MET-5265 Target: 5'-GTTGGAAGAATATTTATAGGCAATACA-3'     (SEQ ID NO: 1040)

5'-CACAAAACAUGUUUAUAAAUGAACA-3'       (SEQ ID NO: 1401)
                 3'-GUGUGUUUUGUACAAAUAUUUACUUGU-5'     (SEQ ID NO:  681)
MET-5313 Target: 5'-CACACAAAACATGTTTATAAATGAACA-3'     (SEQ ID NO: 1041)

5'-GACAUUAAGAAAAUUUGUAUGAAAU-3'       (SEQ ID NO: 1402)
                 3'-UACUGUAAUUCUUUUAAACAUACUUUA-5'     (SEQ ID NO:  682)
MET-5357 Target: 5'-ATGACATTAAGAAAATTTGTATGAAAT-3'     (SEQ ID NO: 1042)

5'-GUGUGUAUUUUUUAAAUGAAAACU-3'        (SEQ ID NO: 1403)
                 3'-AACACACAUAAAAAAAUUUACUUUUGA-5'     (SEQ ID NO:  683)
MET-5479 Target: 5'-TTGTGTGTATTTTTTTAAATGAAAACT-3'     (SEQ ID NO: 1043)

5'-CUCAGCAUGUUUGUAAAGCAGGAUA-3'       (SEQ ID NO: 1404)
                 3'-UUGAGUCGUACAAACAUUUCGUCCUAU-5'     (SEQ ID NO:  684)
MET-5548 Target: 5'-AACTCAGCATGTTTGTAAAGCAGGATA-3'     (SEQ ID NO: 1044)

5'-GAUGGAUUGAAAAGAUUAGCCUCUG-3'       (SEQ ID NO: 1405)
                 3'-ACCUACCUAACUUUUCUAAUCGGAGAC-5'     (SEQ ID NO:  685)
MET-5634 Target: 5'-TGGATGGATTGAAAAGATTAGCCTCTG-3'     (SEQ ID NO: 1045)

5'-UCUGUGGAAUUUUGUGCUUGCUACU-3'       (SEQ ID NO: 1406)
                 3'-UAAGACACCUUAAAACACGAACGAUGA-5'     (SEQ ID NO:  686)
MET-5847 Target: 5'-ATTCTGTGGAATTTTGTGCTTGCTACT-3'     (SEQ ID NO: 1046)

5'-CUGUGGAAUUUUGUGCUUGCUACUG-3'       (SEQ ID NO: 1407)
                 3'-AAGACACCUUAAAACACGAACGAUGAC-5'     (SEQ ID NO:  687)
MET-5848 Target: 5'-TTCTGTGGAATTTTGTGCTTGCTACTG-3'     (SEQ ID NO: 1047)

5'-GUGGAAUUUUGUGCUUGCUACUGUA-3'       (SEQ ID NO: 1408)
                 3'-GACACCUUAAAACACGAACGAUGACAU-5'     (SEQ ID NO:  688)
MET-5850 Target: 5'-CTGTGGAATTTTGTGCTTGCTACTGTA-3'     (SEQ ID NO: 1048)

5'-GAAUUUUGUGCUUGCUACUGUAUAG-3'       (SEQ ID NO: 1409)
                 3'-ACCUUAAAACACGAACGAUGACAUAUC-5'     (SEQ ID NO:  689)
MET-5853 Target: 5'-TGGAATTTTGTGCTTGCTACTGTATAG-3'     (SEQ ID NO: 1049)

5'-UUUUGUGCUUGCUACUGUAUAGUGC-3'       (SEQ ID NO: 1410)
                 3'-UUAAAACACGAACGAUGACAUAUCACG-5'     (SEQ ID NO:  690)
MET-5856 Target: 5'-AATTTTGTGCTTGCTACTGTATAGTGC-3'     (SEQ ID NO: 1050)

5'-UUGUGCUUGCUACUGUAUAGUGCAU-3'       (SEQ ID NO: 1411)
                 3'-AAAACACGAACGAUGACAUAUCACGUA-5'     (SEQ ID NO:  691)
MET-5858 Target: 5'-TTTTGTGCTTGCTACTGTATAGTGCAT-3'     (SEQ ID NO: 1051)

5'-UGUGCUUGCUACUGUAUAGUGCAUG-3'       (SEQ ID NO: 1412)
                 3'-AAAACACGAACGAUGACAUAUCACGUAC-5'    (SEQ ID NO:  692)
MET-5859 Target: 5'-TTTGTGCTTGCTACTGTATAGTGCATG-3'     (SEQ ID NO: 1052)
```

TABLE 3-continued

Selected Human Anti-MET DsiRNAs, Unmodified Duplexes (Asymmetrics)

```
                    5'-GUGCUUGCUACUGUAUAGUGCAUGU-3'      (SEQ ID NO: 1413)
                    3'-AACACGAACGAUGACAUAUCACGUACA-5'    (SEQ ID NO: 693)
MET-5860 Target:    5'-TTGTGCTTGCTACTGTATAGTGCATGT-3'    (SEQ ID NO: 1053)

5'-UGCUUGCUACUGUAUAGUGCAUGUG-3'      (SEQ ID NO: 1414)
                    3'-ACACGAACGAUGACAUAUCACGUACAC-5'    (SEQ ID NO: 694)
MET-5861 Target:    5'-TGTGCTTGCTACTGTATAGTGCATGTG-3'    (SEQ ID NO: 1054)

5'-GCUUGCUACUGUAUAGUGCAUGUGG-3'      (SEQ ID NO: 1415)
                    3'-CACGAACGAUGACAUAUCACGUACACC-5'    (SEQ ID NO: 695)
MET-5862 Target:    5'-GTGCTTGCTACTGTATAGTGCATGTGG-3'    (SEQ ID NO: 1055)

5'-UUGCUACUGUAUAGUGCAUGUGGUG-3'      (SEQ ID NO: 1416)
                    3'-CGAACGAUGACAUAUCACGUACACCAC-5'    (SEQ ID NO: 696)
MET-5864 Target:    5'-GCTTGCTACTGTATAGTGCATGTGGTG-3'    (SEQ ID NO: 1056)

5'-GCUACUGUAUAGUGCAUGUGGUGUA-3'      (SEQ ID NO: 1417)
                    3'-AACGAUGACAUAUCACGUACACCACAU-5'    (SEQ ID NO: 697)
MET-5866 Target:    5'-TTGCTACTGTATAGTGCATGTGGTGTA-3'    (SEQ ID NO: 1057)

5'-CUACUGUAUAGUGCAUGUGGUGUAG-3'      (SEQ ID NO: 1418)
                    3'-ACGAUGACAUAUCACGUACACCACAUC-5'    (SEQ ID NO: 698)
MET-5867 Target:    5'-TGCTACTGTATAGTGCATGTGGTGTAG-3'    (SEQ ID NO: 1058)

5'-UACUGUAUAGUGCAUGUGGUGUAGG-3'      (SEQ ID NO: 1419)
                    3'-CGAUGACAUAUCACGUACACCACAUCC-5'    (SEQ ID NO: 699)
MET-5868 Target:    5'-GCTACTGTATAGTGCATGTGGTGTAGG-3'    (SEQ ID NO: 1059)

5'-AACAUUUAAAGUGUUAUAUUUUUUA-3'      (SEQ ID NO: 1420)
                    3'-AUUUGUAAAUUUCACAAUAUAAAAAAU-5'    (SEQ ID NO: 700)
MET-5919 Target:    5'-TAAACATTTAAAGTGTTATATTTTTA-3'     (SEQ ID NO: 1060)

5'-AAAAUGUUUAUUUUUAAUGAUAUGA-3'      (SEQ ID NO: 1421)
                    3'-AUUUUUACAAAUAAAAAUUACUAUACU-5'    (SEQ ID NO: 701)
MET-5946 Target:    5'-TAAAAATGTTTATTTTTAATGATATGA-3'    (SEQ ID NO: 1061)

5'-AAAUGUUUAUUUUUAAUGAUAUGAG-3'      (SEQ ID NO: 1422)
                    3'-UUUUUACAAAUAAAAAUUACUAUACUC-5'    (SEQ ID NO: 702)
MET-5947 Target:    5'-AAAAATGTTTATTTTTAATGATATGAG-3'    (SEQ ID NO: 1062)

5'-AAUGUUUAUUUUUAAUGAUAUGAGA-3'      (SEQ ID NO: 1423)
                    3'-UUUUACAAAUAAAAAUUACUAUACUCU-5'    (SEQ ID NO: 703)
MET-5948 Target:    5'-AAAATGTTTATTTTTAATGATATGAGA-3'    (SEQ ID NO: 1063)

5'-ACUGUGAACAUUUUAGAAAAGGUAU-3'      (SEQ ID NO: 1424)
                    3'-CGUGACACUUGUAAAAUCUUUUCCAUA-5'    (SEQ ID NO: 704)
MET-6002 Target:    5'-GCACTGTGAACATTTTAGAAAAGGTAT-3'    (SEQ ID NO: 1064)

5'-GAUAAGGAAAUGUACUGAUUGCCAA-3'      (SEQ ID NO: 1425)
                    3'-CGCUAUUCCUUUACAUGACUAACGGUU-5'    (SEQ ID NO: 705)
MET-6075 Target:    5'-GCGATAAGGAAATGTACTGATTGCCAA-3'    (SEQ ID NO: 1065)

5'-AUAAGGAAAUGUACUGAUUGCCAAU-3'      (SEQ ID NO: 1426)
                    3'-GCUAUUCCUUUACAUGACUAACGGUUA-5'    (SEQ ID NO: 706)
MET-6076 Target:    5'-CGATAAGGAAATGTACTGATTGCCAAT-3'    (SEQ ID NO: 1066)

5'-UAAGGAAAUGUACUGAUUGCCAAUA-3'      (SEQ ID NO: 1427)
                    3'-CUAUUCCUUUACAUGACUAACGGUUAU-5'    (SEQ ID NO: 707)
MET-6077 Target:    5'-GATAAGGAAATGTACTGATTGCCAATA-3'    (SEQ ID NO: 1067)

5'-AAGGAAAUGUACUGAUUGCCAAUAC-3'      (SEQ ID NO: 1428)
                    3'-UAUUCCUUUACAUGACUAACGGUUAUG-5'    (SEQ ID NO: 708)
MET-6078 Target:    5'-ATAAGGAAATGTACTGATTGCCAATAC-3'    (SEQ ID NO: 1068)

5'-AGGAAAUGUACUGAUUGCCAAUACA-3'      (SEQ ID NO: 1429)
                    3'-AUUCCUUUACAUGACUAACGGUUAUGU-5'    (SEQ ID NO: 709)
MET-6079 Target:    5'-TAAGGAAATGTACTGATTGCCAATACA-3'    (SEQ ID NO: 1069)

5'-GGAAAUGUACUGAUUGCCAAUACAC-3'      (SEQ ID NO: 1430)
                    3'-UUCCUUUACAUGACUAACGGUUAUGUG-5'    (SEQ ID NO: 710)
MET-6080 Target:    5'-AAGGAAATGTACTGATTGCCAATACAC-3'    (SEQ ID NO: 1070)

5'-CAGGACUUGAAGCCAAGGGUUAACC-3'      (SEQ ID NO: 1431)
                    3'-UAGUCCUGAACUUCGGUUCCCAAUGG-5'    (SEQ ID NO: 711)
MET-6124 Target:    5'-ATCAGGACTTGAAGCCAAGGGTTAACC-3'    (SEQ ID NO: 1071)
```

TABLE 3-continued

Selected Human Anti-MET DsiRNAs, Unmodified Duplexes (Asymmetrics)

```
                5'-AGGACUUGAAGCCAAGGGUUAACCC-3'   (SEQ ID NO: 1432)
                3'-AGUCCUGAACUUCGGUUCCCAAUUGGG-5' (SEQ ID NO: 712)
MET-6125 Target: 5'-TCAGGACTTGAAGCCAAGGGTTAACCC-3' (SEQ ID NO: 1072)

5'-GGACUUGAAGCCAAGGGUUAACCCA-3'   (SEQ ID NO: 1433)
                3'-GUCCUGAACUUCGGUUCCCAAUUGGGU-5' (SEQ ID NO: 713)
MET-6126 Target: 5'-CAGGACTTGAAGCCAAGGGTTAACCCA-3' (SEQ ID NO: 1073)

5'-GACUUGAAGCCAAGGGUUAACCCAG-3'   (SEQ ID NO: 1434)
                3'-UCCUGAACUUCGGUUCCCAAUUGGGUC-5' (SEQ ID NO: 714)
MET-6127 Target: 5'-AGGACTTGAAGCCAAGGGTTAACCCAG-3' (SEQ ID NO: 1074)

5'-ACUUGAAGCCAAGGGUUAACCCAGC-3'   (SEQ ID NO: 1435)
                3'-CCUGAACUUCGGUUCCCAAUUGGGUCG-5' (SEQ ID NO: 715)
MET-6128 Target: 5'-GGACTTGAAGCCAAGGGTTAACCCAGC-3' (SEQ ID NO: 1075)

5'-CCGUUUCAUAAAUGUAAUAAGUAAU-3'   (SEQ ID NO: 1436)
                3'-ACGGCAAAGUAUUUACAUUAUUCAUUA-5' (SEQ ID NO: 716)
MET-6307 Target: 5'-TGCCGTTTCATAAATGTAATAAGTAAT-3' (SEQ ID NO: 1076)

5'-UGCUAUUUAUAAACUUGUCCUUAGA-3'   (SEQ ID NO: 1437)
                3'-AAACGAUAAAUAUUUGAACAGGAAUCU-5' (SEQ ID NO: 717)
MET-6520 Target: 5'-TTTGCTATTTATAAACTTGTCCTTAGA-3' (SEQ ID NO: 1077)

5'-UUGUCACUGCCUAUACCUGCAGCUG-3'   (SEQ ID NO: 1438)
                3'-UGAACAGUGACGGAUAUGGACGUCGAC-5' (SEQ ID NO: 718)
MET-6599 Target: 5'-ACTTGTCACTGCCTATACCTGCAGCTG-3' (SEQ ID NO: 1078)

5'-UGUCACUGCCUAUACCUGCAGCUGA-3'   (SEQ ID NO: 1439)
                3'-GAACAGUGACGGAUAUGGACGUCGACU-5' (SEQ ID NO: 719)
MET-6600 Target: 5'-CTTGTCACTGCCTATACCTGCAGCTGA-3' (SEQ ID NO: 1079)

5'-GUCACUGCCUAUACCUGCAGCUGAA-3'   (SEQ ID NO: 1440)
                3'-AACAGUGACGGAUAUGGACGUCGACUU-5' (SEQ ID NO: 720)
MET-6601 Target: 5'-TTGTCACTGCCTATACCTGCAGCTGAA-3' (SEQ ID NO: 1080)
```

TABLE 4

Selected Mouse Anti-MET DsiRNAs (Asymmetrics)

```
                5'-GCCUCGCCGCCCGCAGCGUCCGAgc-3'   (SEQ ID NO: 2521)
                3'-GCCGGAGCGGCGGGCGUCGCAGGCUCG-5' (SEQ ID NO: 2593)
MET-m65 Target: 5'-CGGCCTCGCCGCCCGCAGCGTCCGAGC-3' (SEQ ID NO: 2665)

5'-GUGCGGAGCCAGAUGCUGGGCGAcc-3'   (SEQ ID NO: 2522)
                3'-GACACGCCUCGGUCUACGACCCGCUGG-5' (SEQ ID NO: 2594)
MET-m102 Target: 5'-CTGTGCGGAGCCAGATGCTGGGCGACC-3' (SEQ ID NO: 2666)

5'-GGAGCCAGAUGCUGGGCGACCGCUg-3'   (SEQ ID NO: 2523)
                3'-CGCCUCGGUCUACGACCCGCUGGCGAC-5' (SEQ ID NO: 2595)
MET-m106 Target: 5'-GCGGAGCCAGATGCTGGGCGACCGCTG-3' (SEQ ID NO: 2667)

5'-AUGCUGGGCGACCGCUGACUCGCUg-3'   (SEQ ID NO: 2524)
                3'-UCUACGACCCGCUGGCGACUGAGCGAC-5' (SEQ ID NO: 2596)
MET-m114 Target: 5'-AGATGCTGGGCGACCGCTGACTCGCTG-3' (SEQ ID NO: 2668)

5'-UGCUGGGCGACCGCUGACUCGCUgg-3'   (SEQ ID NO: 2525)
                3'-CUACGACCCGCUGGCGACUGAGCGACC-5' (SEQ ID NO: 2597)
MET-m115 Target: 5'-GATGCTGGGCGACCGCTGACTCGCTGG-3' (SEQ ID NO: 2669)

5'-CUGGGCGACCGCUGACUCGCUGGag-3'   (SEQ ID NO: 2526)
                3'-ACGACCCGCUGGCGACUGAGCGACCUC-5' (SEQ ID NO: 2598)
MET-m117 Target: 5'-TGCTGGGCGACCGCTGACTCGCTGGAG-3' (SEQ ID NO: 2670)

5'-CAGCCGGCUGACUUCGGCGCCGCgc-3'   (SEQ ID NO: 2527)
                3'-GGGUCGGCCGACUGAAGCCGCGGCGCG-5' (SEQ ID NO: 2599)
MET-m167 Target: 5'-CCCAGCCGGCTGACTTCGGCGCCGCGC-3' (SEQ ID NO: 2671)

5'-GCCGGCUGACUUCGGCGCCGCGCgc-3'   (SEQ ID NO: 2528)
                3'-GUCGGCCGACUGAAGCCGCGGCGCGCG-5' (SEQ ID NO: 2600)
MET-m169 Target: 5'-CAGCCGGCTGACTTCGGCGCCGCGCGC-3' (SEQ ID NO: 2672)
```

TABLE 4-continued

Selected Mouse Anti-MET DsiRNAs (Asymmetrics)

|  |  |  |  |
|---|---|---|---|
| MET-m171 | Target: | 5'-CGGCUGACUUCGGCGCCGCGCGCtc-3'<br>3'-CGGCCGACUGAAGCCGCGGCGCGCGAG-5'<br>5'-GCCGGCTGACTTCGGCGCCGCGCGCTC-3' | (SEQ ID NO: 2529)<br>(SEQ ID NO: 2601)<br>(SEQ ID NO: 2673) |
| MET-m335 | Target: | 5'-GCUGACGGUGUAGCAGAACGCUUgg-3'<br>3'-UUCGACUGCCACAUCGUCUUGCGAACC-5'<br>5'-AAGCTGACGGTGTAGCAGAACGCTTGG-3' | (SEQ ID NO: 2530)<br>(SEQ ID NO: 2602)<br>(SEQ ID NO: 2674) |
| MET-m336 | Target: | 5'-CUGACGGUGUAGCAGAACGCUUGgc-3'<br>3'-UCGACUGCCACAUCGUCUUGCGAACCG-5'<br>5'-AGCTGACGGTGTAGCAGAACGCTTGGC-3' | (SEQ ID NO: 2531)<br>(SEQ ID NO: 2603)<br>(SEQ ID NO: 2675) |
| MET-m400 | Target: | 5'-GGCACCUGGCAUUCUGGUGCUGCtg-3'<br>3'-GACCGUGGACCGUAAGACCACGACGAC-5'<br>5'-CTGGCACCTGGCATTCTGGTGCTGCTG-3' | (SEQ ID NO: 2532)<br>(SEQ ID NO: 2604)<br>(SEQ ID NO: 2676) |
| MET-m402 | Target: | 5'-CACCUGGCAUUCUGGUGCUGCUGtt-3'<br>3'-CCGUGGACCGUAAGACCACGACGACAA-5'<br>5'-GGCACCTGGCATTCTGGTGCTGCTGTT-3' | (SEQ ID NO: 2533)<br>(SEQ ID NO: 2605)<br>(SEQ ID NO: 2677) |
| MET-m403 | Target: | 5'-ACCUGGCAUUCUGGUGCUGCUGUtg-3'<br>3'-CGUGGACCGUAAGACCACGACGACAAC-5'<br>5'-GCACCTGGCATTCTGGTGCTGCTGTTG-3' | (SEQ ID NO: 2534)<br>(SEQ ID NO: 2606)<br>(SEQ ID NO: 2678) |
| MET-m413 | Target: | 5'-CUGGUGCUGCUGUUGUCCUUGGUgc-3'<br>3'-AAGACCACGACGACAACAGGAACCACG-5'<br>5'-TTCTGGTGCTGCTGTTGTCCTTGGTGC-3' | (SEQ ID NO: 2535)<br>(SEQ ID NO: 2607)<br>(SEQ ID NO: 2679) |
| MET-m415 | Target: | 5'-GGUGCUGCUGUUGUCCUUGGUGCag-3'<br>3'-GACCACGACGACAACAGGAACCACGUC-5'<br>5'-CTGGTGCTGCTGTTGTCCTTGGTGCAG-3' | (SEQ ID NO: 2536)<br>(SEQ ID NO: 2608)<br>(SEQ ID NO: 2680) |
| MET-m416 | Target: | 5'-GUGCUGCUGUUGUCCUUGGUGCAga-3'<br>3'-ACCACGACGACAACAGGAACCACGUCU-5'<br>5'-TGGTGCTGCTGTTGTCCTTGGTGCAGA-3' | (SEQ ID NO: 2537)<br>(SEQ ID NO: 2609)<br>(SEQ ID NO: 2681) |
| MET-m419 | Target: | 5'-CUGCUGUUGUCCUUGGUGCAGAGga-3'<br>3'-ACGACGACAACAGGAACCACGUCUCCU-5'<br>5'-TGCTGCTGTTGTCCTTGGTGCAGAGGA-3' | (SEQ ID NO: 2538)<br>(SEQ ID NO: 2610)<br>(SEQ ID NO: 2682) |
| MET-m1221 | Target: | 5'-GUUCCGUAGACUCUGGGUUGCACtc-3'<br>3'-GACAAGGCAUCUGAGACCCAACGUGAG-5'<br>5'-CTGTTCCGTAGACTCTGGGTTGCACTC-3' | (SEQ ID NO: 2539)<br>(SEQ ID NO: 2611)<br>(SEQ ID NO: 2683) |
| MET-m1561 | Target: | 5'-GCACUGUUUCAAUAGGACCCUGCtg-3'<br>3'-CUCGUGACAAAGUUAUCCUGGGACGAC-5'<br>5'-GAGCACTGTTTCAATAGGACCCTGCTG-3' | (SEQ ID NO: 2540)<br>(SEQ ID NO: 2612)<br>(SEQ ID NO: 2684) |
| MET-m1590 | Target: | 5'-ACUCUUCCGGCUGUGAAGCGCGCag-3'<br>3'-UUUGAGAAGGCCGACACUUCGCGCGUC-5'<br>5'-AAACTCTTCCGGCTGTGAAGCGCGCAG-3' | (SEQ ID NO: 2541)<br>(SEQ ID NO: 2613)<br>(SEQ ID NO: 2685) |
| MET-m1592 | Target: | 5'-UCUUCCGGCUGUGAAGCGCGCAGtg-3'<br>3'-UGAGAAGGCCGACACUUCGCGCGUCAC-5'<br>5'-ACTCTTCCGGCTGTGAAGCGCGCAGTG-3' | (SEQ ID NO: 2542)<br>(SEQ ID NO: 2614)<br>(SEQ ID NO: 2686) |
| MET-m1636 | Target: | 5'-UACCACGGCUUUGCAGCGCGUCGac-3'<br>3'-AAAUGGUGCCGAAACGUCGCGCAGCUG-5'<br>5'-TTTACCACGGCTTTGCAGCGCGTCGAC-3' | (SEQ ID NO: 2543)<br>(SEQ ID NO: 2615)<br>(SEQ ID NO: 2687) |
| MET-m1638 | Target: | 5'-CCACGGCUUUGCAGCGCGUCGACtt-3'<br>3'-AUGGUGCCGAAACGUCGCGCAGCUGAA-5'<br>5'-TACCACGGCTTTGCAGCGCGTCGACTT-3' | (SEQ ID NO: 2544)<br>(SEQ ID NO: 2616)<br>(SEQ ID NO: 2688) |
| MET-m1641 | Target: | 5'-CGGCUUUGCAGCGCGUCGACUUAtt-3'<br>3'-GUGCCGAAACGUCGCGCAGCUGAAUAA-5'<br>5'-CACGGCTTTGCAGCGCGTCGACTTATT-3' | (SEQ ID NO: 2545)<br>(SEQ ID NO: 2617)<br>(SEQ ID NO: 2689) |
| MET-m1643 | Target: | 5'-GCUUUGCAGCGCGUCGACUUAUUca-3'<br>3'-GCCGAAACGUCGCGCAGCUGAAUAAGU-5'<br>5'-CGGCTTTGCAGCGCGTCGACTTATTCA-3' | (SEQ ID NO: 2546)<br>(SEQ ID NO: 2618)<br>(SEQ ID NO: 2690) |
| MET-m1644 | Target: | 5'-CUUUGCAGCGCGUCGACUUAUUCat-3'<br>3'-CCGAAACGUCGCGCAGCUGAAUAAGUA-5'<br>5'-GGCTTTGCAGCGCGTCGACTTATTCAT-3' | (SEQ ID NO: 2547)<br>(SEQ ID NO: 2619)<br>(SEQ ID NO: 2691) |

TABLE 4-continued

Selected Mouse Anti-MET DsiRNAs (Asymmetrics)

```
                    5'-UUUGCAGCGCGUCGACUUAUUCAtg-3'      (SEQ ID NO: 2548)
                    3'-CGAAACGUCGCGCAGCUGAAUAAGUAC-5'    (SEQ ID NO: 2620)
MET-m1645 Target:   5'-GCTTTGCAGCGCGTCGACTTATTCATG-3'    (SEQ ID NO: 2692)

5'-UUGCAGCGCGUCGACUUAUUCAUgg-3'      (SEQ ID NO: 2549)
                    3'-GAAACGUCGCGCAGCUGAAUAAGUACC-5'    (SEQ ID NO: 2621)
MET-m1646 Target:   5'-CTTTGCAGCGCGTCGACTTATTCATGG-3'    (SEQ ID NO: 2693)

5'-GCGUCGACUUAUUCAUGGGCCGGct-3'      (SEQ ID NO: 2550)
                    3'-CGCGCAGCUGAAUAAGUACCCGGCCGA-5'    (SEQ ID NO: 2622)
MET-m1653 Target:   5'-GCGCGTCGACTTATTCATGGGCCGGCT-3'    (SEQ ID NO: 2694)

5'-CGCUUCAUGCAGGUGGUGCUCUCtc-3'      (SEQ ID NO: 2551)
                    3'-CAGCGAAGUACGUCCACCACGAGAGAG-5'    (SEQ ID NO: 2623)
MET-m1757 Target:   5'-GTCGCTTCATGCAGGTGGTGCTCTCTC-3'    (SEQ ID NO: 2695)

5'-GUGGUGCUCUCUCGAACAGCACAcc-3'      (SEQ ID NO: 2552)
                    3'-UCCACCACGAGAGAGCUUGUCGUGUGG-5'    (SEQ ID NO: 2624)
MET-m1769 Target:   5'-AGGTGGTGCTCTCTCGAACAGCACACC-3'    (SEQ ID NO: 2696)

5'-GGUGCUCUCUCGAACAGCACACCtc-3'      (SEQ ID NO: 2553)
                    3'-CACCACGAGAGAGCUUGUCGUGUGGAG-5'    (SEQ ID NO: 2625)
MET-m1771 Target:   5'-GTGGTGCTCTCTCGAACAGCACACCTC-3'    (SEQ ID NO: 2697)

5'-GCUUGGCAACGAGAGCUGUACCUtg-3'      (SEQ ID NO: 2554)
                    3'-GACGAACCGUUGCUCUCGACAUGGAAC-5'    (SEQ ID NO: 2626)
MET-m2188 Target:   5'-CTGCTTGGCAACGAGAGCTGTACCTTG-3'    (SEQ ID NO: 2698)

5'-CACUACUCCUUCACUGAAACAGCtg-3'      (SEQ ID NO: 2555)
                    3'-ACGUGAUGAGGAAGUGACUUUGUCGAC-5'    (SEQ ID NO: 2627)
MET-m2779 Target:   5'-TGCACTACTCCTTCACTGAAACAGCTG-3'    (SEQ ID NO: 2699)

5'-CAAGCAGUCUCUUCAACUGUUCUtg-3'      (SEQ ID NO: 2556)
                    3'-UCGUUCGUCAGAGAAGUUGACAAGAAC-5'    (SEQ ID NO: 2628)
MET-m3113 Target:   5'-AGCAAGCAGTCTCTTCAACTGTTCTTG-3'    (SEQ ID NO: 2700)

5'-AAGCAGUCUCUUCAACUGUUCUUgg-3'      (SEQ ID NO: 2557)
                    3'-CGUUCGUCAGAGAAGUUGACAAGAACC-5'    (SEQ ID NO: 2629)
MET-m3114 Target:   5'-GCAAGCAGTCTCTTCAACTGTTCTTGG-3'    (SEQ ID NO: 2701)

5'-GUCUCUUCAACUGUUCUUGGAAAag-3'      (SEQ ID NO: 2558)
                    3'-GUCAGAGAAGUUGACAAGAACCUUUUC-5'    (SEQ ID NO: 2630)
MET-m3119 Target:   5'-CAGTCTCTTCAACTGTTCTTGGAAAAG-3'    (SEQ ID NO: 2702)

5'-AGCACGUAGUGAUUGGACCCAGCag-3'      (SEQ ID NO: 2559)
                    3'-AGUCGUGCAUCACUAACCUGGGUCGUC-5'    (SEQ ID NO: 2631)
MET-m3573 Target:   5'-TCAGCACGTAGTGATTGGACCCAGCAG-3'    (SEQ ID NO: 2703)

5'-GACCCAGCAGCCUGAUUGUGCAUtt-3'      (SEQ ID NO: 2560)
                    3'-ACCUGGGUCGUCGGACUAACACGUAAA-5'    (SEQ ID NO: 2632)
MET-m3588 Target:   5'-TGGACCCAGCAGCCTGATTGTGCATTT-3'    (SEQ ID NO: 2704)

5'-GUCAAGGUUGCUGAUUUCGGUCUtg-3'      (SEQ ID NO: 2561)
                    3'-GACAGUUCCAACGACUAAAGCCAGAAC-5'    (SEQ ID NO: 2633)
MET-m4025 Target:   5'-CTGTCAAGGTTGCTGATTTCGGTCTTG-3'    (SEQ ID NO: 2705)

5'-UUGCUGAUUUCGGUCUUGCCAGAga-3'      (SEQ ID NO: 2562)
                    3'-CCAACGACUAAAGCCAGAACGGUCUCU-5'    (SEQ ID NO: 2634)
MET-m4032 Target:   5'-GGTTGCTGATTTCGGTCTTGCCAGAGA-3'    (SEQ ID NO: 2706)

5'-GCCAAGCUACCAGUAAAGUGGAUgg-3'      (SEQ ID NO: 2563)
                    3'-CACGGUUCGAUGGUCAUUUCACCUACC-5'    (SEQ ID NO: 2635)
MET-m4100 Target:   5'-GTGCCAAGCTACCAGTAAAGTGGATGG-3'    (SEQ ID NO: 2707)

5'-AGCUACCAGUAAAGUGGAUGGCUtt-3'      (SEQ ID NO: 2564)
                    3'-GUUCGAUGGUCAUUUCACCUACCGAAA-5'    (SEQ ID NO: 2636)
MET-m4104 Target:   5'-CAAGCTACCAGTAAAGTGGATGGCTTT-3'    (SEQ ID NO: 2708)

5'-GCUACCAGUAAAGUGGAUGGCUUta-3'      (SEQ ID NO: 2565)
                    3'-UUCGAUGGUCAUUUCACCUACCGAAAU-5'    (SEQ ID NO: 2637)
MET-m4105 Target:   5'-AAGCTACCAGTAAAGTGGATGGCTTTA-3'    (SEQ ID NO: 2709)

5'-UUGGUGUGCUCCUCUGGGAGCUCat-3'      (SEQ ID NO: 2566)
                    3'-GAAACCACACGAGGAGACCCUCGAGUA-5'    (SEQ ID NO: 2638)
MET-m4179 Target:   5'-CTTTGGTGTGCTCCTCTGGGAGCTCAT-3'    (SEQ ID NO: 2710)
```

TABLE 4-continued

Selected Mouse Anti-MET DsiRNAs (Asymmetrics)

|  |  |  |
|---|---|---|
| MET-m4180 Target: | 5'-UGGUGUGCUCCUCUGGGAGCUCAtg-3'<br>3'-AAACCACACGAGGAGACCCUCGAGUAC-5'<br>5'-TTTGGTGTGCTCCTCTGGGAGCTCATG-3' | (SEQ ID NO: 2567)<br>(SEQ ID NO: 2639)<br>(SEQ ID NO: 2711) |
| MET-m4182 Target: | 5'-GUGUGCUCCUCUGGGAGCUCAUGac-3'<br>3'-ACCACACGAGGAGACCCUCGAGUACUG-5'<br>5'-TGGTGTGCTCCTCTGGGAGCTCATGAC-3' | (SEQ ID NO: 2568)<br>(SEQ ID NO: 2640)<br>(SEQ ID NO: 2712) |
| MET-m4639 Target: | 5'-UUGUUUUGUUUUUGUUUUGCUUtt-3'<br>3'-AAAACAAAACAAAAAACAAAACGAAAA-5'<br>5'-TTTTGTTTTGTTTTTGTTTTGCTTTT-3' | (SEQ ID NO: 2569)<br>(SEQ ID NO: 2641)<br>(SEQ ID NO: 2713) |
| MET-m4640 Target: | 5'-UGUUUUGUUUUUGUUUUGCUUUtg-3'<br>3'-AAACAAAACAAAAAACAAAACGAAAAC-5'<br>5'-TTTGTTTTGTTTTTGTTTTGCTTTTG-3' | (SEQ ID NO: 2570)<br>(SEQ ID NO: 2642)<br>(SEQ ID NO: 2714) |
| MET-m4641 Target: | 5'-GUUUUGUUUUUGUUUUGCUUUUgc-3'<br>3'-AACAAAACAAAAAACAAAACGAAAACG-5'<br>5'-TTGTTTTGTTTTTGTTTTGCTTTTGC-3' | (SEQ ID NO: 2571)<br>(SEQ ID NO: 2643)<br>(SEQ ID NO: 2715) |
| MET-m4642 Target: | 5'-UUUUGUUUUUGUUUUGCUUUUGcg-3'<br>3'-ACAAAACAAAAAACAAAACGAAAACGC-5'<br>5'-TGTTTTGTTTTTGTTTTGCTTTTGCG-3' | (SEQ ID NO: 2572)<br>(SEQ ID NO: 2644)<br>(SEQ ID NO: 2716) |
| MET-m4643 Target: | 5'-UUUGUUUUUGUUUUGCUUUUGCgg-3'<br>3'-CAAAACAAAAAACAAAACGAAAACGCC-5'<br>5'-GTTTTGTTTTTGTTTTGCTTTTGCGG-3' | (SEQ ID NO: 2573)<br>(SEQ ID NO: 2645)<br>(SEQ ID NO: 2717) |
| MET-m4645 Target: | 5'-UGUUUUUGUUUUGCUUUUGCGGta-3'<br>3'-AAACAAAAAACAAAACGAAAACGCCAU-5'<br>5'-TTTGTTTTTGTTTTGCTTTTGCGGTA-3' | (SEQ ID NO: 2574)<br>(SEQ ID NO: 2646)<br>(SEQ ID NO: 2718) |
| MET-m4646 Target: | 5'-GUUUUUGUUUUGCUUUUGCGGUaa-3'<br>3'-AACAAAAAACAAAACGAAAACGCCAUU-5'<br>5'-TTGTTTTTGTTTTGCTTTTGCGGTAA-3' | (SEQ ID NO: 2575)<br>(SEQ ID NO: 2647)<br>(SEQ ID NO: 2719) |
| MET-m4647 Target: | 5'-UUUUUGUUUUGCUUUUGCGGUAac-3'<br>3'-ACAAAAAACAAAACGAAAACGCCAUUG-5'<br>5'-TGTTTTTGTTTTGCTTTTGCGGTAAC-3' | (SEQ ID NO: 2576)<br>(SEQ ID NO: 2648)<br>(SEQ ID NO: 2720) |
| MET-m4648 Target: | 5'-UUUUGUUUUGCUUUUGCGGUAAct-3'<br>3'-CAAAAAACAAAACGAAAACGCCAUUGA-5'<br>5'-GTTTTTGTTTTGCTTTTGCGGTAACT-3' | (SEQ ID NO: 2577)<br>(SEQ ID NO: 2649)<br>(SEQ ID NO: 2721) |
| MET-m4649 Target: | 5'-UUUUGUUUUGCUUUUGCGGUAACtg-3'<br>3'-AAAAAACAAAACGAAAACGCCAUUGAC-5'<br>5'-TTTTTTGTTTTGCTTTTGCGGTAACTG-3' | (SEQ ID NO: 2578)<br>(SEQ ID NO: 2650)<br>(SEQ ID NO: 2722) |
| MET-m4650 Target: | 5'-UUUGUUUUGCUUUUGCGGUAACUgc-3'<br>3'-AAAACAAAACGAAAACGCCAUUGACG-5'<br>5'-TTTTTGTTTTGCTTTTGCGGTAACTGC-3' | (SEQ ID NO: 2579)<br>(SEQ ID NO: 2651)<br>(SEQ ID NO: 2723) |
| MET-m4651 Target: | 5'-UUGUUUUGCUUUUGCGGUAACUGca-3'<br>3'-AAACAAAACGAAAACGCCAUUGACGU-5'<br>5'-TTTTGTTTTGCTTTTGCGGTAACTGCA-3' | (SEQ ID NO: 2580)<br>(SEQ ID NO: 2652)<br>(SEQ ID NO: 2724) |
| MET-m4652 Target: | 5'-UGUUUUGCUUUUGCGGUAACUGCac-3'<br>3'-AAACAAAACGAAAACGCCAUUGACGUG-5'<br>5'-TTTGTTTTGCTTTTGCGGTAACTGCAC-3' | (SEQ ID NO: 2581)<br>(SEQ ID NO: 2653)<br>(SEQ ID NO: 2725) |
| MET-m4653 Target: | 5'-GUUUUGCUUUUGCGGUAACUGCAcc-3'<br>3'-AACAAAACGAAAACGCCAUUGACGUGG-5'<br>5'-TTGTTTTGCTTTTGCGGTAACTGCACC-3' | (SEQ ID NO: 2582)<br>(SEQ ID NO: 2654)<br>(SEQ ID NO: 2726) |
| MET-m4654 Target: | 5'-UUUUGCUUUUGCGGUAACUGCACca-3'<br>3'-ACAAAACGAAAACGCCAUUGACGUGGU-5'<br>5'-TGTTTTGCTTTTGCGGTAACTGCACCA-3' | (SEQ ID NO: 2583)<br>(SEQ ID NO: 2655)<br>(SEQ ID NO: 2727) |
| MET-m4655 Target: | 5'-UUUGCUUUUGCGGUAACUGCACCac-3'<br>3'-CAAAACGAAAACGCCAUUGACGUGGUG-5'<br>5'-GTTTTGCTTTTGCGGTAACTGCACCAC-3' | (SEQ ID NO: 2584)<br>(SEQ ID NO: 2656)<br>(SEQ ID NO: 2728) |
| MET-m4656 Target: | 5'-UUGCUUUUGCGGUAACUGCACCAct-3'<br>3'-AAAACGAAAACGCCAUUGACGUGGUGA-5'<br>5'-TTTTGCTTTTGCGGTAACTGCACCACT-3' | (SEQ ID NO: 2585)<br>(SEQ ID NO: 2657)<br>(SEQ ID NO: 2729) |

TABLE 4-continued

Selected Mouse Anti-MET DsiRNAs (Asymmetrics)

```
                  5'-CUUUUGCGGUAACUGCACCACUAtg-3'    (SEQ ID NO: 2586)
                  3'-ACGAAAACGCCAUUGACGUGGUGAUAC-5'  (SEQ ID NO: 2658)
MET-m4659 Target: 5'-TGCTTTTGCGGTAACTGCACCACTATG-3'  (SEQ ID NO: 2730)

5'-CCCAGCUGUUUAGCAAGGAGUGUtg-3'    (SEQ ID NO: 2587)
                  3'-UUGGGUCGACAAAUCGUUCCUCACAAC-5'  (SEQ ID NO: 2659)
MET-m5255 Target: 5'-AACCCAGCTGTTTAGCAAGGAGTGTTG-3'  (SEQ ID NO: 2731)

5'-GCUGUUUAGCAAGGAGUGUUGGCtc-3'    (SEQ ID NO: 2588)
                  3'-GUCGACAAAUCGUUCCUCACAACCGAG-5'  (SEQ ID NO: 2660)
MET-m5259 Target: 5'-CAGCTGTTTAGCAAGGAGTGTTGGCTC-3'  (SEQ ID NO: 2732)

5'-UUGUGCUUACUACUGUAUAGUGCat-3'    (SEQ ID NO: 2589)
                  3'-AAAACACGAAUGAUGACAUAUCACGUA-5'  (SEQ ID NO: 2661)
MET-m5835 Target: 5'-TTTTGTGCTTACTACTGTATAGTGCAT-3'  (SEQ ID NO: 2733)

5'-UGUGCUUACUACUGUAUAGUGCAtg-3'    (SEQ ID NO: 2590)
                  3'-AAACACGAAUGAUGACAUAUCACGUAC-5'  (SEQ ID NO: 2662)
MET-m5836 Target: 5'-TTTGTGCTTACTACTGTATAGTGCATG-3'  (SEQ ID NO: 2734)

5'-GUGCUUACUACUGUAUAGUGCAUgt-3'    (SEQ ID NO: 2591)
                  3'-AACACGAAUGAUGACAUAUCACGUACA-5'  (SEQ ID NO: 2663)
MET-m5837 Target: 5'-TTGTGCTTACTACTGTATAGTGCATGT-3'  (SEQ ID NO: 2735)

5'-GCUUACUACUGUAUAGUGCAUGUgg-3'    (SEQ ID NO: 2592)
                  3'-CACGAAUGAUGACAUAUCACGUACACC-5'  (SEQ ID NO: 2664)
MET-m5839 Target: 5'-GTGCTTACTACTGTATAGTGCATGTGG-3'  (SEQ ID NO: 2736)
```

TABLE 5

Selected Mouse Anti-MET DsiRNAs, Unmodified Duplexes (Asymmetrics)

```
                 5'-GCCUCGCCGCCCGCAGCGUCCGAGC-3'    (SEQ ID NO: 2737)
                 3'-GCCGGAGCGGCGGGCGUCGCAGGCUCG-5'  (SEQ ID NO: 2593)
MET-m65 Target:  5'-CGGCCTCGCCGCCCGCAGCGTCCGAGC-3'  (SEQ ID NO: 2665)

5'-GUGCGGAGCCAGAUGCUGGGCGACC-3'    (SEQ ID NO: 2738)
                 3'-GACACGCCUCGGUCUACGACCCGCUGG-5'  (SEQ ID NO: 2594)
MET-m102 Target: 5'-CTGTGCGGAGCCAGATGCTGGGCGACC-3'  (SEQ ID NO: 2666)

5'-GGAGCCAGAUGCUGGGCGACCGCUG-3'    (SEQ ID NO: 2739)
                 3'-CGCCUCGGUCUACGACCCGCUGGCGAC-5'  (SEQ ID NO: 2595)
MET-m106 Target: 5'-GCGGAGCCAGATGCTGGGCGACCGCTG-3'  (SEQ ID NO: 2667)

5'-AUGCUGGGCGACCGCUGACUCGCUG-3'    (SEQ ID NO: 2740)
                 3'-UCUACGACCCGCUGGCGACUGAGCGAC-5'  (SEQ ID NO: 2596)
MET-m114 Target: 5'-AGATGCTGGGCGACCGCTGACTCGCTG-3'  (SEQ ID NO: 2668)

5'-UGCUGGGCGACCGCUGACUCGCUGG-3'    (SEQ ID NO: 2741)
                 3'-CUACGACCCGCUGGCGACUGAGCGACC-5'  (SEQ ID NO: 2597)
MET-m115 Target: 5'-GATGCTGGGCGACCGCTGACTCGCTGG-3'  (SEQ ID NO: 2669)

5'-CUGGGCGACCGCUGACUCGCUGGAG-3'    (SEQ ID NO: 2742)
                 3'-ACGACCCGCUGGCGACUGAGCGACCUC-5'  (SEQ ID NO: 2598)
MET-m117 Target: 5'-TGCTGGGCGACCGCTGACTCGCTGGAG-3'  (SEQ ID NO: 2670)

5'-CAGCCGGCUGACUUCGGCGCCGCGC-3'    (SEQ ID NO: 2743)
                 3'-GGGUCGGCCGACUGAAGCCGCGGCGCG-5'  (SEQ ID NO: 2599)
MET-m167 Target: 5'-CCCAGCCGGCTGACTTCGGCGCCGCGC-3'  (SEQ ID NO: 2671)

5'-GCCGGCUGACUUCGGCGCCGCGCGC-3'    (SEQ ID NO: 2744)
                 3'-GUCGGCCGACUGAAGCCGCGGCGCGCG-5'  (SEQ ID NO: 2600)
MET-m169 Target: 5'-CAGCCGGCTGACTTCGGCGCCGCGCGC-3'  (SEQ ID NO: 2672)

5'-CGGCUGACUUCGGCGCCGCGCGCUC-3'    (SEQ ID NO: 2745)
                 3'-CGGCCGACUGAAGCCGCGGCGCGCGAG-5'  (SEQ ID NO: 2601)
MET-m171 Target: 5'-GCCGGCTGACTTCGGCGCCGCGCGCTC-3'  (SEQ ID NO: 2673)

5'-GCUGACGGUGUAGCAGAACGCUUGG-3'    (SEQ ID NO: 2746)
                 3'-UUCGACUGCCACAUCGUCUUGCGAACC-5'  (SEQ ID NO: 2602)
MET-m335 Target: 5'-AAGCTGACGGTGTAGCAGAACGCTTGG-3'  (SEQ ID NO: 2674)
```

TABLE 5-continued

Selected Mouse Anti-MET DsiRNAs, Unmodified Duplexes (Asymmetrics)

| | | |
|---|---|---|
| | 5'-CUGACGGUGUAGCAGAACGCUUGGC-3' | (SEQ ID NO: 2747) |
| | 3'-UCGACUGCCACAUCGUCUUGCGAACCG-5' | (SEQ ID NO: 2603) |
| MET-m336 Target: | 5'-AGCTGACGGTGTAGCAGAACGCTTGGC-3' | (SEQ ID NO: 2675) |
| | 5'-GGCACCUGGCAUUCUGGUGCUGCUG-3' | (SEQ ID NO: 2748) |
| | 3'-GACCGUGGACCGUAAGACCACGACGAC-5' | (SEQ ID NO: 2604) |
| MET-m400 Target: | 5'-CTGGCACCTGGCATTCTGGTGCTGCTG-3' | (SEQ ID NO: 2676) |
| | 5'-CACCUGGCAUUCUGGUGCUGCUGUU-3' | (SEQ ID NO: 2749) |
| | 3'-CCGUGGACCGUAAGACCACGACGACAA-5' | (SEQ ID NO: 2605) |
| MET-m402 Target: | 5'-GGCACCTGGCATTCTGGTGCTGCTGTT-3' | (SEQ ID NO: 2677) |
| | 5'-ACCUGGCAUUCUGGUGCUGCUGUUG-3' | (SEQ ID NO: 2750) |
| | 3'-CGUGGACCGUAAGACCACGACGACAAC-5' | (SEQ ID NO: 2606) |
| MET-m403 Target: | 5'-GCACCTGGCATTCTGGTGCTGCTGTTG-3' | (SEQ ID NO: 2678) |
| | 5'-CUGGUGCUGCUGUUGUCCUUGGUGC-3' | (SEQ ID NO: 2751) |
| | 3'-AAGACCACGACGACAACAGGAACCACG-5' | (SEQ ID NO: 2607) |
| MET-m413 Target: | 5'-TTCTGGTGCTGCTGTTGTCCTTGGTGC-3' | (SEQ ID NO: 2679) |
| | 5'-GGUGCUGCUGUUGUCCUUGGUGCAG-3' | (SEQ ID NO: 2752) |
| | 3'-GACCACGACGACAACAGGAACCACGUC-5' | (SEQ ID NO: 2608) |
| MET-m415 Target: | 5'-CTGGTGCTGCTGTTGTCCTTGGTGCAG-3' | (SEQ ID NO: 2680) |
| | 5'-GUGCUGCUGUUGUCCUUGGUGCAGA-3' | (SEQ ID NO: 2753) |
| | 3'-ACCACGACGACAACAGGAACCACGUCU-5' | (SEQ ID NO: 2609) |
| MET-m416 Target: | 5'-TGGTGCTGCTGTTGTCCTTGGTGCAGA-3' | (SEQ ID NO: 2681) |
| | 5'-CUGCUGUUGUCCUUGGUGCAGAGGA-3' | (SEQ ID NO: 2754) |
| | 3'-ACGACGACAACAGGAACCACGUCUCCU-5' | (SEQ ID NO: 2610) |
| MET-m419 Target: | 5'-TGCTGCTGTTGTCCTTGGTGCAGAGGA-3' | (SEQ ID NO: 2682) |
| | 5'-GUUCCGUAGACUCUGGGUUGCACUC-3' | (SEQ ID NO: 2755) |
| | 3'-GACAAGGCAUCUGAGACCCAACGUGAG-5' | (SEQ ID NO: 2611) |
| MET-m1221 Target: | 5'-CTGTTCCGTAGACTCTGGGTTGCACTC-3' | (SEQ ID NO: 2683) |
| | 5'-GCACUGUUUCAAUAGGACCCUGCUG-3' | (SEQ ID NO: 2756) |
| | 3'-CUCGUGACAAAGUUAUCCUGGGACGAC-5' | (SEQ ID NO: 2612) |
| MET-m1561 Target: | 5'-GAGCACTGTTTCAATAGGACCCTGCTG-3' | (SEQ ID NO: 2684) |
| | 5'-ACUCUUCCGGCUGUGAAGCGCGCAG-3' | (SEQ ID NO: 2757) |
| | 3'-UUUGAGAAGGCCGACACUUCGCGCGUC-5' | (SEQ ID NO: 2613) |
| MET-m1590 Target: | 5'-AAACTCTTCCGGCTGTGAAGCGCGCAG-3' | (SEQ ID NO: 2685) |
| | 5'-UCUUCCGGCUGUGAAGCGCGCAGUG-3' | (SEQ ID NO: 2758) |
| | 3'-UGAGAAGGCCGACACUUCGCGCGUCAC-5' | (SEQ ID NO: 2614) |
| MET-m1592 Target: | 5'-ACTCTTCCGGCTGTGAAGCGCGCAGTG-3' | (SEQ ID NO: 2686) |
| | 5'-UACCACGGCUUUGCAGCGCGUCGAC-3' | (SEQ ID NO: 2759) |
| | 3'-AAAUGGUGCCGAAACGUCGCGCAGCUG-5' | (SEQ ID NO: 2615) |
| MET-m1636 Target: | 5'-TTTACCACGGCTTTGCAGCGCGTCGAC-3' | (SEQ ID NO: 2687) |
| | 5'-CCACGGCUUUGCAGCGCGUCGACUU-3' | (SEQ ID NO: 2760) |
| | 3'-AUGGUGCCGAAACGUCGCGCAGCUGAA-5' | (SEQ ID NO: 2616) |
| MET-m1638 Target: | 5'-TACCACGGCTTTGCAGCGCGTCGACTT-3' | (SEQ ID NO: 2688) |
| | 5'-CGGCUUUGCAGCGCGUCGACUUAUU-3' | (SEQ ID NO: 2761) |
| | 3'-GUGCCGAAACGUCGCGCAGCUGAAUAA-5' | (SEQ ID NO: 2617) |
| MET-m1641 Target: | 5'-CACGGCTTTGCAGCGCGTCGACTTATT-3' | (SEQ ID NO: 2689) |
| | 5'-GCUUUGCAGCGCGUCGACUUAUUCA-3' | (SEQ ID NO: 2762) |
| | 3'-GCCGAAACGUCGCGCAGCUGAAUAAGU-5' | (SEQ ID NO: 2618) |
| MET-m1643 Target: | 5'-CGGCTTTGCAGCGCGTCGACTTATTCA-3' | (SEQ ID NO: 2690) |
| | 5'-CUUUGCAGCGCGUCGACUUAUUCAU-3' | (SEQ ID NO: 2763) |
| | 3'-CCGAAACGUCGCGCAGCUGAAUAAGUA-5' | (SEQ ID NO: 2619) |
| MET-m1644 Target: | 5'-GGCTTTGCAGCGCGTCGACTTATTCAT-3' | (SEQ ID NO: 2691) |
| | 5'-UUUGCAGCGCGUCGACUUAUUCAUG-3' | (SEQ ID NO: 2764) |
| | 3'-CGAAACGUCGCGCAGCUGAAUAAGUAC-5' | (SEQ ID NO: 2620) |
| MET-m1645 Target: | 5'-GCTTTGCAGCGCGTCGACTTATTCATG-3' | (SEQ ID NO: 2692) |
| | 5'-UUGCAGCGCGUCGACUUAUUCAUGG-3' | (SEQ ID NO: 2765) |
| | 3'-GAAACGUCGCGCAGCUGAAUAAGUACC-5' | (SEQ ID NO: 2621) |
| MET-m1646 Target: | 5'-CTTTGCAGCGCGTCGACTTATTCATGG-3' | (SEQ ID NO: 2693) |

TABLE 5-continued

Selected Mouse Anti-MET DsiRNAs, Unmodified Duplexes (Asymmetrics)

|  |  |  |
|---|---|---|
| MET-m1653 Target: | 5'-GCGUCGACUUAUUCAUGGGCCGGCU-3'<br>3'-CGCGCAGCUGAAUAAGUACCCGGCCGA-5'<br>5'-GCGCGTCGACTTATTCATGGGCCGGCT-3' | (SEQ ID NO: 2766)<br>(SEQ ID NO: 2622)<br>(SEQ ID NO: 2694) |
| MET-m1757 Target: | 5'-CGCUUCAUGCAGGUGGUGCUCUCUC-3'<br>3'-CAGCGAAGUACGUCCACCACGAGAGAG-5'<br>5'-GTCGCTTCATGCAGGTGGTGCTCTCTC-3' | (SEQ ID NO: 2767)<br>(SEQ ID NO: 2623)<br>(SEQ ID NO: 2695) |
| MET-m1769 Target: | 5'-GUGGUGCUCUCUCGAACAGCACACC-3'<br>3'-UCCACCACGAGAGAGCUUGUCGUGUGG-5'<br>5'-AGGTGGTGCTCTCTCGAACAGCACACC-3' | (SEQ ID NO: 2768)<br>(SEQ ID NO: 2624)<br>(SEQ ID NO: 2696) |
| MET-m1771 Target: | 5'-GGUGCUCUCUCGAACAGCACACCUC-3'<br>3'-CACCACGAGAGAGCUUGUCGUGUGGAG-5'<br>5'-GTGGTGCTCTCTCGAACAGCACACCTC-3' | (SEQ ID NO: 2769)<br>(SEQ ID NO: 2625)<br>(SEQ ID NO: 2697) |
| MET-m2188 Target: | 5'-GCUUGGCAACGAGAGCUGUACCUUG-3'<br>3'-GACGAACCGUUGCUCUCGACAUGGAAC-5'<br>5'-CTGCTTGGCAACGAGAGCTGTACCTTG-3' | (SEQ ID NO: 2770)<br>(SEQ ID NO: 2626)<br>(SEQ ID NO: 2698) |
| MET-m2779 Target: | 5'-CACUACUCCUUCACUGAAACAGCUG-3'<br>3'-ACGUGAUGAGGAAGUGACUUUGUCGAC-5'<br>5'-TGCACTACTCCTTCACTGAAACAGCTG-3' | (SEQ ID NO: 2771)<br>(SEQ ID NO: 2627)<br>(SEQ ID NO: 2699) |
| MET-m3113 Target: | 5'-CAAGCAGUCUCUUCAACUGUUCUUG-3'<br>3'-UCGUUCGUCAGAGAAGUUGACAAGAAC-5'<br>5'-AGCAAGCAGTCTCTTCAACTGTTCTTG-3' | (SEQ ID NO: 2772)<br>(SEQ ID NO: 2628)<br>(SEQ ID NO: 2700) |
| MET-m3114 Target: | 5'-AAGCAGUCUCUUCAACUGUUCUUGG-3'<br>3'-CGUUCGUCAGAGAAGUUGACAAGAACC-5'<br>5'-GCAAGCAGTCTCTTCAACTGTTCTTGG-3' | (SEQ ID NO: 2773)<br>(SEQ ID NO: 2629)<br>(SEQ ID NO: 2701) |
| MET-m3119 Target: | 5'-GUCUCUUCAACUGUUCUUGGAAAAG-3'<br>3'-GUCAGAGAAGUUGACAAGAACCUUUUC-5'<br>5'-CAGTCTCTTCAACTGTTCTTGGAAAAG-3' | (SEQ ID NO: 2774)<br>(SEQ ID NO: 2630)<br>(SEQ ID NO: 2702) |
| MET-m3573 Target: | 5'-AGCACGUAGUGAUUGGACCCAGCAG-3'<br>3'-AGUCGUGCAUCACUAACCUGGGUCGUC-5'<br>5'-TCAGCACGTAGTGATTGGACCCAGCAG-3' | (SEQ ID NO: 2775)<br>(SEQ ID NO: 2631)<br>(SEQ ID NO: 2703) |
| MET-m3588 Target: | 5'-GACCCAGCAGCCUGAUUGUGCAUUU-3'<br>3'-ACCUGGGUCGUCGGACUAACACGUAAA-5'<br>5'-TGGACCCAGCAGCCTGATTGTGCATTT-3' | (SEQ ID NO: 2776)<br>(SEQ ID NO: 2632)<br>(SEQ ID NO: 2704) |
| MET-m4025 Target: | 5'-GUCAAGGUUGCUGAUUUCGGUCUUG-3'<br>3'-GACAGUUCCAACGACUAAAGCCAGAAC-5'<br>5'-CTGTCAAGGTTGCTGATTTCGGTCTTG-3' | (SEQ ID NO: 2777)<br>(SEQ ID NO: 2633)<br>(SEQ ID NO: 2705) |
| MET-m4032 Target: | 5'-UUGCUGAUUUCGGUCUUGCCAGAGA-3'<br>3'-CCAACGACUAAAGCCAGAACGGUCUCU-5'<br>5'-GGTTGCTGATTTCGGTCTTGCCAGAGA-3' | (SEQ ID NO: 2778)<br>(SEQ ID NO: 2634)<br>(SEQ ID NO: 2706) |
| MET-m4100 Target: | 5'-GCCAAGCUACCAGUAAAGUGGAUGG-3'<br>3'-CACGGUUCGAUGGUCAUUUCACCUACC-5'<br>5'-GTGCCAAGCTACCAGTAAAGTGGATGG-3' | (SEQ ID NO: 2779)<br>(SEQ ID NO: 2635)<br>(SEQ ID NO: 2707) |
| MET-m4104 Target: | 5'-AGCUACCAGUAAAGUGGAUGGCUUU-3'<br>3'-GUUCGAUGGUCAUUUCACCUACCGAAA-5'<br>5'-CAAGCTACCAGTAAAGTGGATGGCTTT-3' | (SEQ ID NO: 2780)<br>(SEQ ID NO: 2636)<br>(SEQ ID NO: 2708) |
| MET-m4105 Target: | 5'-GCUACCAGUAAAGUGGAUGGCUUUA-3'<br>3'-UUCGAUGGUCAUUUCACCUACCGAAAU-5'<br>5'-AAGCTACCAGTAAAGTGGATGGCTTTA-3' | (SEQ ID NO: 2781)<br>(SEQ ID NO: 2637)<br>(SEQ ID NO: 2709) |
| MET-m4179 Target: | 5'-UUGGUGUGCUCCUCUGGGAGCUCAU-3'<br>3'-GAAACCACACGAGGAGACCCUCGAGUA-5'<br>5'-CTTTGGTGTGCTCCTCTGGGAGCTCAT-3' | (SEQ ID NO: 2782)<br>(SEQ ID NO: 2638)<br>(SEQ ID NO: 2710) |
| MET-m4180 Target: | 5'-UGGUGUGCUCCUCUGGGAGCUCAUG-3'<br>3'-AAACCACACGAGGAGACCCUCGAGUAC-5'<br>5'-TTTGGTGTGCTCCTCTGGGAGCTCATG-3' | (SEQ ID NO: 2783)<br>(SEQ ID NO: 2639)<br>(SEQ ID NO: 2711) |
| MET-m4182 Target: | 5'-GUGUGCUCCUCUGGGAGCUCAUGAC-3'<br>3'-ACCACACGAGGAGACCCUCGAGUACUG-5'<br>5'-TGGTGTGCTCCTCTGGGAGCTCATGAC-3' | (SEQ ID NO: 2784)<br>(SEQ ID NO: 2640)<br>(SEQ ID NO: 2712) |

TABLE 5-continued

Selected Mouse Anti-MET DsiRNAs, Unmodified Duplexes (Asymmetrics)

|  |  |  |
|---|---|---|
|  | 5'-UUGUUUUGUUUUUGUUUUGCUUUU-3' | (SEQ ID NO: 2785) |
|  | 3'-AAAACAAAACAAAAAACAAAACGAAAA-5' | (SEQ ID NO: 2641) |
| MET-m4639 Target: | 5'-TTTTGTTTTGTTTTTGTTTTGCTTTT-3' | (SEQ ID NO: 2713) |
|  | 5'-UGUUUUGUUUUUGUUUUGCUUUUG-3' | (SEQ ID NO: 2786) |
|  | 3'-AAACAAAACAAAAAACAAAACGAAAAC-5' | (SEQ ID NO: 2642) |
| MET-m4640 Target: | 5'-TTTGTTTTGTTTTTGTTTTGCTTTTG-3' | (SEQ ID NO: 2714) |
|  | 5'-GUUUUGUUUUUGUUUUGCUUUUGC-3' | (SEQ ID NO: 2787) |
|  | 3'-AACAAAACAAAAAACAAAACGAAAACG-5' | (SEQ ID NO: 2643) |
| MET-m4641 Target: | 5'-TTGTTTTGTTTTTGTTTTGCTTTTGC-3' | (SEQ ID NO: 2715) |
|  | 5'-UUUUGUUUUUGUUUUGCUUUUGCG-3' | (SEQ ID NO: 2788) |
|  | 3'-ACAAAACAAAAAACAAAACGAAAACGC-5' | (SEQ ID NO: 2644) |
| MET-m4642 Target: | 5'-TGTTTTGTTTTTGTTTTGCTTTTGCG-3' | (SEQ ID NO: 2716) |
|  | 5'-UUUGUUUUUGUUUUGCUUUUGCGG-3' | (SEQ ID NO: 2789) |
|  | 3'-CAAAACAAAAAACAAAACGAAAACGCC-5' | (SEQ ID NO: 2645) |
| MET-m4643 Target: | 5'-GTTTTGTTTTTGTTTTGCTTTTGCGG-3' | (SEQ ID NO: 2717) |
|  | 5'-UGUUUUUGUUUUGCUUUUGCGGUA-3' | (SEQ ID NO: 2790) |
|  | 3'-AAACAAAAAACAAAACGAAAACGCCAU-5' | (SEQ ID NO: 2646) |
| MET-m4645 Target: | 5'-TTTGTTTTTGTTTTGCTTTTGCGGTA-3' | (SEQ ID NO: 2718) |
|  | 5'-GUUUUUGUUUUGCUUUUGCGGUAA-3' | (SEQ ID NO: 2791) |
|  | 3'-AACAAAAAACAAAACGAAAACGCCAUU-5' | (SEQ ID NO: 2647) |
| MET-m4646 Target: | 5'-TTGTTTTTGTTTTGCTTTTGCGGTAA-3' | (SEQ ID NO: 2719) |
|  | 5'-UUUUUGUUUUGCUUUUGCGGUAAC-3' | (SEQ ID NO: 2792) |
|  | 3'-ACAAAAAACAAAACGAAAACGCCAUUG-5' | (SEQ ID NO: 2648) |
| MET-m4647 Target: | 5'-TGTTTTTGTTTTGCTTTTGCGGTAAC-3' | (SEQ ID NO: 2720) |
|  | 5'-UUUUGUUUUGCUUUUGCGGUAACU-3' | (SEQ ID NO: 2793) |
|  | 3'-CAAAAAACAAAACGAAAACGCCAUUGA-5' | (SEQ ID NO: 2649) |
| MET-m4648 Target: | 5'-GTTTTTGTTTTGCTTTTGCGGTAACT-3' | (SEQ ID NO: 2721) |
|  | 5'-UUUGUUUUGCUUUUGCGGUAACUG-3' | (SEQ ID NO: 2794) |
|  | 3'-AAAAAACAAAACGAAAACGCCAUUGAC-5' | (SEQ ID NO: 2650) |
| MET-m4649 Target: | 5'-TTTTTGTTTTGCTTTTGCGGTAACTG-3' | (SEQ ID NO: 2722) |
|  | 5'-UUUGUUUUGCUUUUGCGGUAACUGC-3' | (SEQ ID NO: 2795) |
|  | 3'-AAAACAAAACGAAAACGCCAUUGACG-5' | (SEQ ID NO: 2651) |
| MET-m4650 Target: | 5'-TTTTTGTTTTGCTTTTGCGGTAACTGC-3' | (SEQ ID NO: 2723) |
|  | 5'-UUGUUUUGCUUUUGCGGUAACUGCA-3' | (SEQ ID NO: 2796) |
|  | 3'-AAAACAAAACGAAAACGCCAUUGACGU-5' | (SEQ ID NO: 2652) |
| MET-m4651 Target: | 5'-TTTTGTTTTGCTTTTGCGGTAACTGCA-3' | (SEQ ID NO: 2724) |
|  | 5'-UGUUUUGCUUUUGCGGUAACUGCAC-3' | (SEQ ID NO: 2797) |
|  | 3'-AAACAAAACGAAAACGCCAUUGACGUG-5' | (SEQ ID NO: 2653) |
| MET-m4652 Target: | 5'-TTTGTTTTGCTTTTGCGGTAACTGCAC-3' | (SEQ ID NO: 2725) |
|  | 5'-GUUUUGCUUUUGCGGUAACUGCACC-3' | (SEQ ID NO: 2798) |
|  | 3'-AACAAAACGAAAACGCCAUUGACGUGG-5' | (SEQ ID NO: 2654) |
| MET-m4653 Target: | 5'-TTGTTTTGCTTTTGCGGTAACTGCACC-3' | (SEQ ID NO: 2726) |
|  | 5'-UUUUGCUUUUGCGGUAACUGCACCA-3' | (SEQ ID NO: 2799) |
|  | 3'-ACAAAACGAAAACGCCAUUGACGUGGU-5' | (SEQ ID NO: 2655) |
| MET-m4654 Target: | 5'-TGTTTTGCTTTTGCGGTAACTGCACCA-3' | (SEQ ID NO: 2727) |
|  | 5'-UUUGCUUUUGCGGUAACUGCACCAC-3' | (SEQ ID NO: 2800) |
|  | 3'-CAAAACGAAAACGCCAUUGACGUGGUG-5' | (SEQ ID NO: 2656) |
| MET-m4655 Target: | 5'-GTTTTGCTTTTGCGGTAACTGCACCAC-3' | (SEQ ID NO: 2728) |
|  | 5'-UUGCUUUUGCGGUAACUGCACCACU-3' | (SEQ ID NO: 2801) |
|  | 3'-AAAACGAAAACGCCAUUGACGUGGUGA-5' | (SEQ ID NO: 2657) |
| MET-m4656 Target: | 5'-TTTTGCTTTTGCGGTAACTGCACCACT-3' | (SEQ ID NO: 2729) |
|  | 5'-CUUUUGCGGUAACUGCACCACUAUG-3' | (SEQ ID NO: 2802) |
|  | 3'-ACGAAAACGCCAUUGACGUGGUGAUAC-5' | (SEQ ID NO: 2658) |
| MET-m4659 Target: | 5'-TGCTTTTGCGGTAACTGCACCACTATG-3' | (SEQ ID NO: 2730) |
|  | 5'-CCCAGCUGUUUAGCAAGGAGUGUUG-3' | (SEQ ID NO: 2803) |
|  | 3'-UUGGGUCGACAAAUCGUUCCUCACAAC-5' | (SEQ ID NO: 2659) |
| MET-m5255 Target: | 5'-AACCCAGCTGTTTAGCAAGGAGTGTTG-3' | (SEQ ID NO: 2731) |

TABLE 5-continued

Selected Mouse Anti-MET DsiRNAs, Unmodified Duplexes (Asymmetrics)

|  |  |  |
|---|---|---|
|  | 5'-GCUGUUUAGCAAGGAGUGUUGGCUC-3' | (SEQ ID NO: 2804) |
|  | 3'-GUCGACAAAUCGUUCCUCACAACCGAG-5' | (SEQ ID NO: 2660) |
| MET-m5259 Target: | 5'-CAGCTGTTTAGCAAGGAGTGTTGGCTC-3' | (SEQ ID NO: 2732) |
|  | 5'-UUGUGCUUACUACUGUAUAGUGCAU-3' | (SEQ ID NO: 2805) |
|  | 3'-AAAACACGAAUGAUGACAUAUCACGUA-5' | (SEQ ID NO: 2661) |
| MET-m5835 Target: | 5'-TTTTGTGCTTACTACTGTATAGTGCAT-3' | (SEQ ID NO: 2733) |
|  | 5'-UGUGCUUACUACUGUAUAGUGCAUG-3' | (SEQ ID NO: 2806) |
|  | 3'-AAACACGAAUGAUGACAUAUCACGUAC-5' | (SEQ ID NO: 2662) |
| MET-m5836 Target: | 5'-TTTGTGCTTACTACTGTATAGTGCATG-3' | (SEQ ID NO: 2734) |
|  | 5'-GUGCUUACUACUGUAUAGUGCAUGU-3' | (SEQ ID NO: 2807) |
|  | 3'-AACACGAAUGAUGACAUAUCACGUACA-5' | (SEQ ID NO: 2663) |
| MET-m5837 Target: | 5'-TTGTGCTTACTACTGTATAGTGCATGT-3' | (SEQ ID NO: 2735) |
|  | 5'-GCUUACUACUGUAUAGUGCAUGUGG-3' | (SEQ ID NO: 2808) |
|  | 3'-CACGAAUGAUGACAUAUCACGUACACC-5' | (SEQ ID NO: 2664) |
| MET-m5839 Target: | 5'-GTGCTTACTACTGTATAGTGCATGTGG-3' | (SEQ ID NO: 2736) |

Projected 21 nucleotide target sequences for each DsiRNA of Tables 2-5 above and of Tables 7-10 below are presented in Table 6.

TABLE 6

DsiRNA Target Sequences (21mers) In MET mRNA

| | | |
|---|---|---|
| MET-136 21 nt Target: | 5'-GGCGCGGAGCGCGCGUGUGGU-3' | (SEQ ID NO: 1441) |
| MET-137 21 nt Target: | 5'-GCGCGGAGCGCGCGUGUGGUC-3' | (SEQ ID NO: 1442) |
| MET-138 21 nt Target: | 5'-CGCGGAGCGCGCGUGUGGUCC-3' | (SEQ ID NO: 1443) |
| MET-140 21 nt Target: | 5'-CGGAGCGCGCGUGUGGUCCUU-3' | (SEQ ID NO: 1444) |
| MET-142 21 nt Target: | 5'-GAGCGCGCGUGUGGUCCUUGC-3' | (SEQ ID NO: 1445) |
| MET-143 21 nt Target: | 5'-AGCGCGCGUGUGGUCCUUGCG-3' | (SEQ ID NO: 1446) |
| MET-145 21 nt Target: | 5'-CGCGCGUGUGGUCCUUGCGCC-3' | (SEQ ID NO: 1447) |
| MET-146 21 nt Target: | 5'-GCGCGUGUGGUCCUUGCGCCG-3' | (SEQ ID NO: 1448) |
| MET-148 21 nt Target: | 5'-GCGUGUGGUCCUUGCGCCGCU-3' | (SEQ ID NO: 1449) |
| MET-155 21 nt Target: | 5'-GUCCUUGCGCCGCUGACUUCU-3' | (SEQ ID NO: 1450) |
| MET-159 21 nt Target: | 5'-UUGCGCCGCUGACUUCUCCAC-3' | (SEQ ID NO: 1451) |
| MET-225 21 nt Target: | 5'-CGCUGUGCUUGCACCUGGCAU-3' | (SEQ ID NO: 1452) |
| MET-227 21 nt Target: | 5'-CUGUGCUUGCACCUGGCAUCC-3' | (SEQ ID NO: 1453) |
| MET-234 21 nt Target: | 5'-UGCACCUGGCAUCCUCGUGCU-3' | (SEQ ID NO: 1454) |
| MET-245 21 nt Target: | 5'-UCCUCGUGCUCCUGUUUACCU-3' | (SEQ ID NO: 1455) |
| MET-248 21 nt Target: | 5'-UCGUGCUCCUGUUUACCUUGG-3' | (SEQ ID NO: 1456) |
| MET-249 21 nt Target: | 5'-CGUGCUCCUGUUUACCUUGGU-3' | (SEQ ID NO: 1457) |
| MET-409 21 nt Target: | 5'-GCCACUAACUACAUUUAUGUU-3' | (SEQ ID NO: 1458) |
| MET-413 21 nt Target: | 5'-CUAACUACAUUUAUGUUUAA-3' | (SEQ ID NO: 1459) |
| MET-414 21 nt Target: | 5'-UAACUACAUUUAUGUUUAAA-3' | (SEQ ID NO: 1460) |
| MET-415 21 nt Target: | 5'-AACUACAUUUAUGUUUAAAU-3' | (SEQ ID NO: 1461) |
| MET-416 21 nt Target: | 5'-ACUACAUUUAUGUUUAAAUG-3' | (SEQ ID NO: 1462) |
| MET-417 21 nt Target: | 5'-CUACAUUUAUGUUUAAAUGA-3' | (SEQ ID NO: 1463) |

TABLE 6-continued

DsiRNA Target Sequences (21mers) In MET mRNA

| | | |
|---|---|---|
| MET-480 21 nt Target: | 5'-GCUGGAACACCCAGAUUGUUU-3' | (SEQ ID NO: 1464) |
| MET-508 21 nt Target: | 5'-CAGGACUGCAGCAGCAAAGCC-3' | (SEQ ID NO: 1465) |
| MET-509 21 nt Target: | 5'-AGGACUGCAGCAGCAAAGCCA-3' | (SEQ ID NO: 1466) |
| MET-510 21 nt Target: | 5'-GGACUGCAGCAGCAAAGCCAA-3' | (SEQ ID NO: 1467) |
| MET-511 21 nt Target: | 5'-GACUGCAGCAGCAAAGCCAAU-3' | (SEQ ID NO: 1468) |
| MET-512 21 nt Target: | 5'-ACUGCAGCAGCAAAGCCAAUU-3' | (SEQ ID NO: 1469) |
| MET-584 21 nt Target: | 5'-CCUACUAUGAUGAUCAACUCA-3' | (SEQ ID NO: 1470) |
| MET-585 21 nt Target: | 5'-CUACUAUGAUGAUCAACUCAU-3' | (SEQ ID NO: 1471) |
| MET-586 21 nt Target: | 5'-UACUAUGAUGAUCAACUCAUU-3' | (SEQ ID NO: 1472) |
| MET-587 21 nt Target: | 5'-ACUAUGAUGAUCAACUCAUUA-3' | (SEQ ID NO: 1473) |
| MET-588 21 nt Target: | 5'-CUAUGAUGAUCAACUCAUUAG-3' | (SEQ ID NO: 1474) |
| MET-589 21 nt Target: | 5'-UAUGAUGAUCAACUCAUUAGC-3' | (SEQ ID NO: 1475) |
| MET-590 21 nt Target: | 5'-AUGAUGAUCAACUCAUUAGCU-3' | (SEQ ID NO: 1476) |
| MET-591 21 nt Target: | 5'-UGAUGAUCAACUCAUUAGCUG-3' | (SEQ ID NO: 1477) |
| MET-592 21 nt Target: | 5'-GAUGAUCAACUCAUUAGCUGU-3' | (SEQ ID NO: 1478) |
| MET-593 21 nt Target: | 5'-AUGAUCAACUCAUUAGCUGUG-3' | (SEQ ID NO: 1479) |
| MET-594 21 nt Target: | 5'-UGAUCAACUCAUUAGCUGUGG-3' | (SEQ ID NO: 1480) |
| MET-595 21 nt Target: | 5'-GAUCAACUCAUUAGCUGUGGC-3' | (SEQ ID NO: 1481) |
| MET-596 21 nt Target: | 5'-AUCAACUCAUUAGCUGUGGCA-3' | (SEQ ID NO: 1482) |
| MET-597 21 nt Target: | 5'-UCAACUCAUUAGCUGUGGCAG-3' | (SEQ ID NO: 1483) |
| MET-881 21 nt Target: | 5'-AAGAUGGUUUUAUGUUUUUGA-3' | (SEQ ID NO: 1484) |
| MET-967 21 nt Target: | 5'-GCCUUUGAAAGCAACAAUUUU-3' | (SEQ ID NO: 1485) |
| MET-1009 21 nt Target: | 5'-AGGGAAACUCUAGAUGCUCAG-3' | (SEQ ID NO: 1486) |
| MET-1010 21 nt Target: | 5'-GGGAAACUCUAGAUGCUCAGA-3' | (SEQ ID NO: 1487) |
| MET-1011 21 nt Target: | 5'-GGAAACUCUAGAUGCUCAGAC-3' | (SEQ ID NO: 1488) |
| MET-1012 21 nt Target: | 5'-GAAACUCUAGAUGCUCAGACU-3' | (SEQ ID NO: 1489) |
| MET-1013 21 nt Target: | 5'-AAACUCUAGAUGCUCAGACUU-3' | (SEQ ID NO: 1490) |
| MET-1014 21 nt Target: | 5'-AACUCUAGAUGCUCAGACUUU-3' | (SEQ ID NO: 1491) |
| MET-1036 21 nt Target: | 5'-CACACAAGAAUAAUCAGGUUC-3' | (SEQ ID NO: 1492) |
| MET-1038 21 nt Target: | 5'-CACAAGAAUAAUCAGGUUCUG-3' | (SEQ ID NO: 1493) |
| MET-1039 21 nt Target: | 5'-ACAAGAAUAAUCAGGUUCUGU-3' | (SEQ ID NO: 1494) |
| MET-1040 21 nt Target: | 5'-CAAGAAUAAUCAGGUUCUGUU-3' | (SEQ ID NO: 1495) |
| MET-1041 21 nt Target: | 5'-AAGAAUAAUCAGGUUCUGUUC-3' | (SEQ ID NO: 1496) |
| MET-1042 21 nt Target: | 5'-AGAAUAAUCAGGUUCUGUUCC-3' | (SEQ ID NO: 1497) |
| MET-1056 21 nt Target: | 5'-CUGUUCCAUAAACUCUGGAUU-3' | (SEQ ID NO: 1498) |
| MET-1099 21 nt Target: | 5'-CUGGAGUGUAUUCUCACAGAA-3' | (SEQ ID NO: 1499) |
| MET-1144 21 nt Target: | 5'-AAGGAAGUGUUUAAUAUACUU-3' | (SEQ ID NO: 1500) |
| MET-1163 21 nt Target: | 5'-UUCAGGCUGCGUAUGUCAGCA-3' | (SEQ ID NO: 1501) |
| MET-1250 21 nt Target: | 5'-UCGCACAAAGCAAGCCAGAUU-3' | (SEQ ID NO: 1502) |

TABLE 6-continued

DsiRNA Target Sequences (21mers) In MET mRNA

| | | |
|---|---|---|
| MET-1251 21 nt Target: | 5'-CGCACAAAGCAAGCCAGAUUC-3' | (SEQ ID NO: 1503) |
| MET-1252 21 nt Target: | 5'-GCACAAAGCAAGCCAGAUUCU-3' | (SEQ ID NO: 1504) |
| MET-1253 21 nt Target: | 5'-CACAAAGCAAGCCAGAUUCUG-3' | (SEQ ID NO: 1505) |
| MET-1254 21 nt Target: | 5'-ACAAAGCAAGCCAGAUUCUGC-3' | (SEQ ID NO: 1506) |
| MET-1358 21 nt Target: | 5'-AUGUGAGAUGUCUCCAGCAUU-3' | (SEQ ID NO: 1507) |
| MET-1359 21 nt Target: | 5'-UGUGAGAUGUCUCCAGCAUUU-3' | (SEQ ID NO: 1508) |
| MET-1360 21 nt Target: | 5'-GUGAGAUGUCUCCAGCAUUUU-3' | (SEQ ID NO: 1509) |
| MET-1361 21 nt Target: | 5'-UGAGAUGUCUCCAGCAUUUUU-3' | (SEQ ID NO: 1510) |
| MET-1362 21 nt Target: | 5'-GAGAUGUCUCCAGCAUUUUUA-3' | (SEQ ID NO: 1511) |
| MET-1363 21 nt Target: | 5'-AGAUGUCUCCAGCAUUUUUAC-3' | (SEQ ID NO: 1512) |
| MET-1364 21 nt Target: | 5'-GAUGUCUCCAGCAUUUUUACG-3' | (SEQ ID NO: 1513) |
| MET-1365 21 nt Target: | 5'-AUGUCUCCAGCAUUUUUACGG-3' | (SEQ ID NO: 1514) |
| MET-1366 21 nt Target: | 5'-UGUCUCCAGCAUUUUUACGGA-3' | (SEQ ID NO: 1515) |
| MET-1367 21 nt Target: | 5'-GUCUCCAGCAUUUUUACGGAC-3' | (SEQ ID NO: 1516) |
| MET-1368 21 nt Target: | 5'-UCUCCAGCAUUUUUACGGACC-3' | (SEQ ID NO: 1517) |
| MET-1369 21 nt Target: | 5'-CUCCAGCAUUUUUACGGACCC-3' | (SEQ ID NO: 1518) |
| MET-1370 21 nt Target: | 5'-UCCAGCAUUUUUACGGACCCA-3' | (SEQ ID NO: 1519) |
| MET-1371 21 nt Target: | 5'-CCAGCAUUUUUACGGACCCAA-3' | (SEQ ID NO: 1520) |
| MET-1469 21 nt Target: | 5'-AGUUUACCACAGCUUUGCAGC-3' | (SEQ ID NO: 1521) |
| MET-1471 21 nt Target: | 5'-UUUACCACAGCUUUGCAGCGC-3' | (SEQ ID NO: 1522) |
| MET-1473 21 nt Target: | 5'-UACCACAGCUUUGCAGCGCGU-3' | (SEQ ID NO: 1523) |
| MET-1474 21 nt Target: | 5'-ACCACAGCUUUGCAGCGCGUU-3' | (SEQ ID NO: 1524) |
| MET-1476 21 nt Target: | 5'-CACAGCUUUGCAGCGCGUUGA-3' | (SEQ ID NO: 1525) |
| MET-1478 21 nt Target: | 5'-CAGCUUUGCAGCGCGUUGACU-3' | (SEQ ID NO: 1526) |
| MET-1479 21 nt Target: | 5'-AGCUUUGCAGCGCGUUGACUU-3' | (SEQ ID NO: 1527) |
| MET-1480 21 nt Target: | 5'-GCUUUGCAGCGCGUUGACUUA-3' | (SEQ ID NO: 1528) |
| MET-1481 21 nt Target: | 5'-CUUUGCAGCGCGUUGACUUAU-3' | (SEQ ID NO: 1529) |
| MET-1953 21 nt Target: | 5'-GCUGACCAUAUGUGGCUGGGA-3' | (SEQ ID NO: 1530) |
| MET-1954 21 nt Target: | 5'-CUGACCAUAUGUGGCUGGGAC-3' | (SEQ ID NO: 1531) |
| MET-1955 21 nt Target: | 5'-UGACCAUAUGUGGCUGGGACU-3' | (SEQ ID NO: 1532) |
| MET-1956 21 nt Target: | 5'-GACCAUAUGUGGCUGGGACUU-3' | (SEQ ID NO: 1533) |
| MET-1957 21 nt Target: | 5'-ACCAUAUGUGGCUGGGACUUU-3' | (SEQ ID NO: 1534) |
| MET-1958 21 nt Target: | 5'-CCAUAUGUGGCUGGGACUUUG-3' | (SEQ ID NO: 1535) |
| MET-1959 21 nt Target: | 5'-CAUAUGUGGCUGGGACUUUGG-3' | (SEQ ID NO: 1536) |
| MET-1960 21 nt Target: | 5'-AUAUGUGGCUGGGACUUUGGA-3' | (SEQ ID NO: 1537) |
| MET-1961 21 nt Target: | 5'-UAUGUGGCUGGGACUUUGGAU-3' | (SEQ ID NO: 1538) |
| MET-1962 21 nt Target: | 5'-AUGUGGCUGGGACUUUGGAUU-3' | (SEQ ID NO: 1539) |
| MET-1982 21 nt Target: | 5'-UUCGGAGGAAUAAUAAAUUUG-3' | (SEQ ID NO: 1540) |
| MET-1987 21 nt Target: | 5'-AGGAAUAAUAAAUUUGAUUUA-3' | (SEQ ID NO: 1541) |

TABLE 6-continued

DsiRNA Target Sequences (21mers) In MET mRNA

| | | | |
|---|---|---|---|
| MET-1988 21 nt Target: | 5'-GGAAUAAUAAAUUUGAUUUAA-3' | (SEQ ID NO: 1542) |
| MET-2075 21 nt Target: | 5'-CAUUGAAAUGCACAGUUGGUC-3' | (SEQ ID NO: 1543) |
| MET-2076 21 nt Target: | 5'-AUUGAAAUGCACAGUUGGUCC-3' | (SEQ ID NO: 1544) |
| MET-2113 21 nt Target: | 5'-UUCAAUAUGUCCAUAAUUAUU-3' | (SEQ ID NO: 1545) |
| MET-2290 21 nt Target: | 5'-GGUGGAAAAACAUGUACUUUA-3' | (SEQ ID NO: 1546) |
| MET-2668 21 nt Target: | 5'-UGUACCACUCCUUCCCUGCAA-3' | (SEQ ID NO: 1547) |
| MET-2790 21 nt Target: | 5'-UAAGCCUUUUGAAAAGCCAGU-3' | (SEQ ID NO: 1548) |
| MET-2856 21 nt Target: | 5'-UGAUAUUGACCCUGAAGCAGU-3' | (SEQ ID NO: 1549) |
| MET-2857 21 nt Target: | 5'-GAUAUUGACCCUGAAGCAGUU-3' | (SEQ ID NO: 1550) |
| MET-2858 21 nt Target: | 5'-AUAUUGACCCUGAAGCAGUUA-3' | (SEQ ID NO: 1551) |
| MET-2859 21 nt Target: | 5'-UAUUGACCCUGAAGCAGUUAA-3' | (SEQ ID NO: 1552) |
| MET-2860 21 nt Target: | 5'-AUUGACCCUGAAGCAGUUAAA-3' | (SEQ ID NO: 1553) |
| MET-2861 21 nt Target: | 5'-UUGACCCUGAAGCAGUUAAAG-3' | (SEQ ID NO: 1554) |
| MET-2862 21 nt Target: | 5'-UGACCCUGAAGCAGUUAAAGG-3' | (SEQ ID NO: 1555) |
| MET-2863 21 nt Target: | 5'-GACCCUGAAGCAGUUAAAGGU-3' | (SEQ ID NO: 1556) |
| MET-2864 21 nt Target: | 5'-ACCCUGAAGCAGUUAAAGGUG-3' | (SEQ ID NO: 1557) |
| MET-2865 21 nt Target: | 5'-CCCUGAAGCAGUUAAAGGUGA-3' | (SEQ ID NO: 1558) |
| MET-2866 21 nt Target: | 5'-CCUGAAGCAGUUAAAGGUGAA-3' | (SEQ ID NO: 1559) |
| MET-2867 21 nt Target: | 5'-CUGAAGCAGUUAAAGGUGAAG-3' | (SEQ ID NO: 1560) |
| MET-2868 21 nt Target: | 5'-UGAAGCAGUUAAAGGUGAAGU-3' | (SEQ ID NO: 1561) |
| MET-2869 21 nt Target: | 5'-GAAGCAGUUAAAGGUGAAGUG-3' | (SEQ ID NO: 1562) |
| MET-2870 21 nt Target: | 5'-AAGCAGUUAAAGGUGAAGUGU-3' | (SEQ ID NO: 1563) |
| MET-2871 21 nt Target: | 5'-AGCAGUUAAAGGUGAAGUGUU-3' | (SEQ ID NO: 1564) |
| MET-2872 21 nt Target: | 5'-GCAGUUAAAGGUGAAGUGUUA-3' | (SEQ ID NO: 1565) |
| MET-2873 21 nt Target: | 5'-CAGUUAAAGGUGAAGUGUUAA-3' | (SEQ ID NO: 1566) |
| MET-2874 21 nt Target: | 5'-AGUUAAAGGUGAAGUGUUAAA-3' | (SEQ ID NO: 1567) |
| MET-2875 21 nt Target: | 5'-GUUAAAGGUGAAGUGUUAAAA-3' | (SEQ ID NO: 1568) |
| MET-2876 21 nt Target: | 5'-UUAAAGGUGAAGUGUUAAAAG-3' | (SEQ ID NO: 1569) |
| MET-2877 21 nt Target: | 5'-UAAAGGUGAAGUGUUAAAAGU-3' | (SEQ ID NO: 1570) |
| MET-2878 21 nt Target: | 5'-AAAGGUGAAGUGUUAAAAGUU-3' | (SEQ ID NO: 1571) |
| MET-2879 21 nt Target: | 5'-AAGGUGAAGUGUUAAAAGUUG-3' | (SEQ ID NO: 1572) |
| MET-2880 21 nt Target: | 5'-AGGUGAAGUGUUAAAAGUUGG-3' | (SEQ ID NO: 1573) |
| MET-2881 21 nt Target: | 5'-GGUGAAGUGUUAAAAGUUGGA-3' | (SEQ ID NO: 1574) |
| MET-2882 21 nt Target: | 5'-GUGAAGUGUUAAAAGUUGGAA-3' | (SEQ ID NO: 1575) |
| MET-2883 21 nt Target: | 5'-UGAAGUGUUAAAAGUUGGAAA-3' | (SEQ ID NO: 1576) |
| MET-2884 21 nt Target: | 5'-GAAGUGUUAAAAGUUGGAAAU-3' | (SEQ ID NO: 1577) |
| MET-2973 21 nt Target: | 5'-AUUGAACAGCGAGCUAAAUAU-3' | (SEQ ID NO: 1578) |
| MET-2974 21 nt Target: | 5'-UUGAACAGCGAGCUAAAUAUA-3' | (SEQ ID NO: 1579) |
| MET-2975 21 nt Target: | 5'-UGAACAGCGAGCUAAAUAUAG-3' | (SEQ ID NO: 1580) |

TABLE 6-continued

DsiRNA Target Sequences (21mers) In MET mRNA

| | | | |
|---|---|---|---|
| MET-2976 21 nt Target: | 5'-GAACAGCGAGCUAAAUAUAGA-3' | (SEQ ID NO: 1581) |
| MET-2977 21 nt Target: | 5'-AACAGCGAGCUAAAUAUAGAG-3' | (SEQ ID NO: 1582) |
| MET-2978 21 nt Target: | 5'-ACAGCGAGCUAAAUAUAGAGU-3' | (SEQ ID NO: 1583) |
| MET-2979 21 nt Target: | 5'-CAGCGAGCUAAAUAUAGAGUG-3' | (SEQ ID NO: 1584) |
| MET-2980 21 nt Target: | 5'-AGCGAGCUAAAUAUAGAGUGG-3' | (SEQ ID NO: 1585) |
| MET-2981 21 nt Target: | 5'-GCGAGCUAAAUAUAGAGUGGA-3' | (SEQ ID NO: 1586) |
| MET-2982 21 nt Target: | 5'-CGAGCUAAAUAUAGAGUGGAA-3' | (SEQ ID NO: 1587) |
| MET-2983 21 nt Target: | 5'-GAGCUAAAUAUAGAGUGGAAG-3' | (SEQ ID NO: 1588) |
| MET-2984 21 nt Target: | 5'-AGCUAAAUAUAGAGUGGAAGC-3' | (SEQ ID NO: 1589) |
| MET-2985 21 nt Target: | 5'-GCUAAAUAUAGAGUGGAAGCA-3' | (SEQ ID NO: 1590) |
| MET-2986 21 nt Target: | 5'-CUAAAUAUAGAGUGGAAGCAA-3' | (SEQ ID NO: 1591) |
| MET-2987 21 nt Target: | 5'-UAAAUAUAGAGUGGAAGCAAG-3' | (SEQ ID NO: 1592) |
| MET-2988 21 nt Target: | 5'-AAAUAUAGAGUGGAAGCAAGC-3' | (SEQ ID NO: 1593) |
| MET-2989 21 nt Target: | 5'-AAUAUAGAGUGGAAGCAAGCA-3' | (SEQ ID NO: 1594) |
| MET-3112 21 nt Target: | 5'-CUUGGGUUUUCCUGUGGCUG-3' | (SEQ ID NO: 1595) |
| MET-3126 21 nt Target: | 5'-GUGGCUGAAAAAGAGAAAGCA-3' | (SEQ ID NO: 1596) |
| MET-3148 21 nt Target: | 5'-AUUAAAGAUCUGGGCAGUGAA-3' | (SEQ ID NO: 1597) |
| MET-3149 21 nt Target: | 5'-UUAAAGAUCUGGGCAGUGAAU-3' | (SEQ ID NO: 1598) |
| MET-3150 21 nt Target: | 5'-UAAAGAUCUGGGCAGUGAAUU-3' | (SEQ ID NO: 1599) |
| MET-3151 21 nt Target: | 5'-AAAGAUCUGGGCAGUGAAUUA-3' | (SEQ ID NO: 1600) |
| MET-3152 21 nt Target: | 5'-AAGAUCUGGGCAGUGAAUUAG-3' | (SEQ ID NO: 1601) |
| MET-3153 21 nt Target: | 5'-AGAUCUGGGCAGUGAAUUAGU-3' | (SEQ ID NO: 1602) |
| MET-3154 21 nt Target: | 5'-GAUCUGGGCAGUGAAUUAGUU-3' | (SEQ ID NO: 1603) |
| MET-3155 21 nt Target: | 5'-AUCUGGGCAGUGAAUUAGUUC-3' | (SEQ ID NO: 1604) |
| MET-3156 21 nt Target: | 5'-UCUGGGCAGUGAAUUAGUUCG-3' | (SEQ ID NO: 1605) |
| MET-3157 21 nt Target: | 5'-CUGGGCAGUGAAUUAGUUCGC-3' | (SEQ ID NO: 1606) |
| MET-3158 21 nt Target: | 5'-UGGGCAGUGAAUUAGUUCGCU-3' | (SEQ ID NO: 1607) |
| MET-3159 21 nt Target: | 5'-GGGCAGUGAAUUAGUUCGCUA-3' | (SEQ ID NO: 1608) |
| MET-3193 21 nt Target: | 5'-CACACUCCUCAUUUGGAUAGG-3' | (SEQ ID NO: 1609) |
| MET-3194 21 nt Target: | 5'-ACACUCCUCAUUUGGAUAGGC-3' | (SEQ ID NO: 1610) |
| MET-3195 21 nt Target: | 5'-CACUCCUCAUUUGGAUAGGCU-3' | (SEQ ID NO: 1611) |
| MET-3196 21 nt Target: | 5'-ACUCCUCAUUUGGAUAGGCUU-3' | (SEQ ID NO: 1612) |
| MET-3197 21 nt Target: | 5'-CUCCUCAUUUGGAUAGGCUUG-3' | (SEQ ID NO: 1613) |
| MET-3198 21 nt Target: | 5'-UCCUCAUUUGGAUAGGCUUGU-3' | (SEQ ID NO: 1614) |
| MET-3199 21 nt Target: | 5'-CCUCAUUUGGAUAGGCUUGUA-3' | (SEQ ID NO: 1615) |
| MET-3200 21 nt Target: | 5'-CUCAUUUGGAUAGGCUUGUAA-3' | (SEQ ID NO: 1616) |
| MET-3201 21 nt Target: | 5'-UCAUUUGGAUAGGCUUGUAAG-3' | (SEQ ID NO: 1617) |
| MET-3202 21 nt Target: | 5'-CAUUUGGAUAGGCUUGUAAGU-3' | (SEQ ID NO: 1618) |
| MET-3203 21 nt Target: | 5'-AUUUGGAUAGGCUUGUAAGUG-3' | (SEQ ID NO: 1619) |

TABLE 6-continued

DsiRNA Target Sequences (21mers) In MET mRNA

| | | | |
|---|---|---|---|
| MET-3204 21 nt Target: | 5'-UUUGGAUAGGCUUGUAAGUGC-3' | (SEQ ID NO: 1620) |
| MET-3205 21 nt Target: | 5'-UUGGAUAGGCUUGUAAGUGCC-3' | (SEQ ID NO: 1621) |
| MET-3206 21 nt Target: | 5'-UGGAUAGGCUUGUAAGUGCCC-3' | (SEQ ID NO: 1622) |
| MET-3207 21 nt Target: | 5'-GGAUAGGCUUGUAAGUGCCCG-3' | (SEQ ID NO: 1623) |
| MET-3208 21 nt Target: | 5'-GAUAGGCUUGUAAGUGCCCGA-3' | (SEQ ID NO: 1624) |
| MET-3209 21 nt Target: | 5'-AUAGGCUUGUAAGUGCCCGAA-3' | (SEQ ID NO: 1625) |
| MET-3210 21 nt Target: | 5'-UAGGCUUGUAAGUGCCCGAAG-3' | (SEQ ID NO: 1626) |
| MET-3211 21 nt Target: | 5'-AGGCUUGUAAGUGCCCGAAGU-3' | (SEQ ID NO: 1627) |
| MET-3212 21 nt Target: | 5'-GGCUUGUAAGUGCCCGAAGUG-3' | (SEQ ID NO: 1628) |
| MET-3213 21 nt Target: | 5'-GCUUGUAAGUGCCCGAAGUGU-3' | (SEQ ID NO: 1629) |
| MET-3214 21 nt Target: | 5'-CUUGUAAGUGCCCGAAGUGUA-3' | (SEQ ID NO: 1630) |
| MET-3215 21 nt Target: | 5'-UUGUAAGUGCCCGAAGUGUAA-3' | (SEQ ID NO: 1631) |
| MET-3216 21 nt Target: | 5'-UGUAAGUGCCCGAAGUGUAAG-3' | (SEQ ID NO: 1632) |
| MET-3276 21 nt Target: | 5'-CCGAGCUACUUUUCCAGAAGA-3' | (SEQ ID NO: 1633) |
| MET-3419 21 nt Target: | 5'-UCCACAUUGACCUCAGUGCUC-3' | (SEQ ID NO: 1634) |
| MET-3420 21 nt Target: | 5'-CCACAUUGACCUCAGUGCUCU-3' | (SEQ ID NO: 1635) |
| MET-3421 21 nt Target: | 5'-CACAUUGACCUCAGUGCUCUA-3' | (SEQ ID NO: 1636) |
| MET-3422 21 nt Target: | 5'-ACAUUGACCUCAGUGCUCUAA-3' | (SEQ ID NO: 1637) |
| MET-3423 21 nt Target: | 5'-CAUUGACCUCAGUGCUCUAAA-3' | (SEQ ID NO: 1638) |
| MET-3424 21 nt Target: | 5'-AUUGACCUCAGUGCUCUAAAU-3' | (SEQ ID NO: 1639) |
| MET-3425 21 nt Target: | 5'-UUGACCUCAGUGCUCUAAAUC-3' | (SEQ ID NO: 1640) |
| MET-3426 21 nt Target: | 5'-UGACCUCAGUGCUCUAAAUCC-3' | (SEQ ID NO: 1641) |
| MET-3427 21 nt Target: | 5'-GACCUCAGUGCUCUAAAUCCA-3' | (SEQ ID NO: 1642) |
| MET-3428 21 nt Target: | 5'-ACCUCAGUGCUCUAAAUCCAG-3' | (SEQ ID NO: 1643) |
| MET-3429 21 nt Target: | 5'-CCUCAGUGCUCUAAAUCCAGA-3' | (SEQ ID NO: 1644) |
| MET-3430 21 nt Target: | 5'-CUCAGUGCUCUAAAUCCAGAG-3' | (SEQ ID NO: 1645) |
| MET-3431 21 nt Target: | 5'-UCAGUGCUCUAAAUCCAGAGC-3' | (SEQ ID NO: 1646) |
| MET-3432 21 nt Target: | 5'-CAGUGCUCUAAAUCCAGAGCU-3' | (SEQ ID NO: 1647) |
| MET-3433 21 nt Target: | 5'-AGUGCUCUAAAUCCAGAGCUG-3' | (SEQ ID NO: 1648) |
| MET-3434 21 nt Target: | 5'-GUGCUCUAAAUCCAGAGCUGG-3' | (SEQ ID NO: 1649) |
| MET-3435 21 nt Target: | 5'-UGCUCUAAAUCCAGAGCUGGU-3' | (SEQ ID NO: 1650) |
| MET-3436 21 nt Target: | 5'-GCUCUAAAUCCAGAGCUGGUC-3' | (SEQ ID NO: 1651) |
| MET-3437 21 nt Target: | 5'-CUCUAAAUCCAGAGCUGGUCC-3' | (SEQ ID NO: 1652) |
| MET-3438 21 nt Target: | 5'-UCUAAAUCCAGAGCUGGUCCA-3' | (SEQ ID NO: 1653) |
| MET-3488 21 nt Target: | 5'-GUAGCCUGAUUGUGCAUUUCA-3' | (SEQ ID NO: 1654) |
| MET-3489 21 nt Target: | 5'-UAGCCUGAUUGUGCAUUUCAA-3' | (SEQ ID NO: 1655) |
| MET-3490 21 nt Target: | 5'-AGCCUGAUUGUGCAUUUCAAU-3' | (SEQ ID NO: 1656) |
| MET-3491 21 nt Target: | 5'-GCCUGAUUGUGCAUUUCAAUG-3' | (SEQ ID NO: 1657) |
| MET-3492 21 nt Target: | 5'-CCUGAUUGUGCAUUUCAAUGA-3' | (SEQ ID NO: 1658) |

TABLE 6-continued

DsiRNA Target Sequences (21mers) In MET mRNA

| | | | |
|---|---|---|---|
| MET-3493 21 nt Target: | 5'-CUGAUUGUGCAUUUCAAUGAA-3' | (SEQ ID NO: 1659) |
| MET-3494 21 nt Target: | 5'-UGAUUGUGCAUUUCAAUGAAG-3' | (SEQ ID NO: 1660) |
| MET-3495 21 nt Target: | 5'-GAUUGUGCAUUUCAAUGAAGU-3' | (SEQ ID NO: 1661) |
| MET-3496 21 nt Target: | 5'-AUUGUGCAUUUCAAUGAAGUC-3' | (SEQ ID NO: 1662) |
| MET-3497 21 nt Target: | 5'-UUGUGCAUUUCAAUGAAGUCA-3' | (SEQ ID NO: 1663) |
| MET-3498 21 nt Target: | 5'-UGUGCAUUUCAAUGAAGUCAU-3' | (SEQ ID NO: 1664) |
| MET-3499 21 nt Target: | 5'-GUGCAUUUCAAUGAAGUCAUA-3' | (SEQ ID NO: 1665) |
| MET-3500 21 nt Target: | 5'-UGCAUUUCAAUGAAGUCAUAG-3' | (SEQ ID NO: 1666) |
| MET-3501 21 nt Target: | 5'-GCAUUUCAAUGAAGUCAUAGG-3' | (SEQ ID NO: 1667) |
| MET-3502 21 nt Target: | 5'-CAUUUCAAUGAAGUCAUAGGA-3' | (SEQ ID NO: 1668) |
| MET-3503 21 nt Target: | 5'-AUUUCAAUGAAGUCAUAGGAA-3' | (SEQ ID NO: 1669) |
| MET-3504 21 nt Target: | 5'-UUUCAAUGAAGUCAUAGGAAG-3' | (SEQ ID NO: 1670) |
| MET-3505 21 nt Target: | 5'-UUCAAUGAAGUCAUAGGAAGA-3' | (SEQ ID NO: 1671) |
| MET-3506 21 nt Target: | 5'-UCAAUGAAGUCAUAGGAAGAG-3' | (SEQ ID NO: 1672) |
| MET-3507 21 nt Target: | 5'-CAAUGAAGUCAUAGGAAGAGG-3' | (SEQ ID NO: 1673) |
| MET-3508 21 nt Target: | 5'-AAUGAAGUCAUAGGAAGAGGG-3' | (SEQ ID NO: 1674) |
| MET-3509 21 nt Target: | 5'-AUGAAGUCAUAGGAAGAGGGC-3' | (SEQ ID NO: 1675) |
| MET-3510 21 nt Target: | 5'-UGAAGUCAUAGGAAGAGGGCA-3' | (SEQ ID NO: 1676) |
| MET-3511 21 nt Target: | 5'-GAAGUCAUAGGAAGAGGGCAU-3' | (SEQ ID NO: 1677) |
| MET-3512 21 nt Target: | 5'-AAGUCAUAGGAAGAGGGCAUU-3' | (SEQ ID NO: 1678) |
| MET-3513 21 nt Target: | 5'-AGUCAUAGGAAGAGGGCAUUU-3' | (SEQ ID NO: 1679) |
| MET-3514 21 nt Target: | 5'-GUCAUAGGAAGAGGGCAUUUU-3' | (SEQ ID NO: 1680) |
| MET-3515 21 nt Target: | 5'-UCAUAGGAAGAGGGCAUUUUG-3' | (SEQ ID NO: 1681) |
| MET-3572 21 nt Target: | 5'-GCAAGAAAAUUCACUGUGCUG-3' | (SEQ ID NO: 1682) |
| MET-3573 21 nt Target: | 5'-CAAGAAAAUUCACUGUGCUGU-3' | (SEQ ID NO: 1683) |
| MET-3574 21 nt Target: | 5'-AAGAAAAUUCACUGUGCUGUG-3' | (SEQ ID NO: 1684) |
| MET-3575 21 nt Target: | 5'-AGAAAAUUCACUGUGCUGUGA-3' | (SEQ ID NO: 1685) |
| MET-3576 21 nt Target: | 5'-GAAAAUUCACUGUGCUGUGAA-3' | (SEQ ID NO: 1686) |
| MET-3577 21 nt Target: | 5'-AAAAUUCACUGUGCUGUGAAA-3' | (SEQ ID NO: 1687) |
| MET-3578 21 nt Target: | 5'-AAAUUCACUGUGCUGUGAAAU-3' | (SEQ ID NO: 1688) |
| MET-3579 21 nt Target: | 5'-AAUUCACUGUGCUGUGAAAUC-3' | (SEQ ID NO: 1689) |
| MET-3580 21 nt Target: | 5'-AUUCACUGUGCUGUGAAAUCC-3' | (SEQ ID NO: 1690) |
| MET-3581 21 nt Target: | 5'-UUCACUGUGCUGUGAAAUCCU-3' | (SEQ ID NO: 1691) |
| MET-3582 21 nt Target: | 5'-UCACUGUGCUGUGAAAUCCUU-3' | (SEQ ID NO: 1692) |
| MET-3644 21 nt Target: | 5'-CCGAGGGAAUCAUCAUGAAAG-3' | (SEQ ID NO: 1693) |
| MET-3645 21 nt Target: | 5'-CGAGGGAAUCAUCAUGAAAGA-3' | (SEQ ID NO: 1694) |
| MET-3779 21 nt Target: | 5'-AUGAGACUCAUAAUCCAACUG-3' | (SEQ ID NO: 1695) |
| MET-3780 21 nt Target: | 5'-UGAGACUCAUAAUCCAACUGU-3' | (SEQ ID NO: 1696) |
| MET-3795 21 nt Target: | 5'-AACUGUAAAAGAUCUUAUUGG-3' | (SEQ ID NO: 1697) |

TABLE 6-continued

DsiRNA Target Sequences (21mers) In MET mRNA

| | | | |
|---|---|---|---|
| MET-3812 21 nt Target: | 5'-UUGGCUUUGGUCUUCAAGUAG-3' | (SEQ ID NO: 1698) |
| MET-3821 21 nt Target: | 5'-GUCUUCAAGUAGCCAAAGGCA-3' | (SEQ ID NO: 1699) |
| MET-3822 21 nt Target: | 5'-UCUUCAAGUAGCCAAAGGCAU-3' | (SEQ ID NO: 1700) |
| MET-3823 21 nt Target: | 5'-CUUCAAGUAGCCAAAGGCAUG-3' | (SEQ ID NO: 1701) |
| MET-3824 21 nt Target: | 5'-UUCAAGUAGCCAAAGGCAUGA-3' | (SEQ ID NO: 1702) |
| MET-3825 21 nt Target: | 5'-UCAAGUAGCCAAAGGCAUGAA-3' | (SEQ ID NO: 1703) |
| MET-3826 21 nt Target: | 5'-CAAGUAGCCAAAGGCAUGAAA-3' | (SEQ ID NO: 1704) |
| MET-3827 21 nt Target: | 5'-AAGUAGCCAAAGGCAUGAAAU-3' | (SEQ ID NO: 1705) |
| MET-3828 21 nt Target: | 5'-AGUAGCCAAAGGCAUGAAAUA-3' | (SEQ ID NO: 1706) |
| MET-3829 21 nt Target: | 5'-GUAGCCAAAGGCAUGAAAUAU-3' | (SEQ ID NO: 1707) |
| MET-3830 21 nt Target: | 5'-UAGCCAAAGGCAUGAAAUAUC-3' | (SEQ ID NO: 1708) |
| MET-3831 21 nt Target: | 5'-AGCCAAAGGCAUGAAAUAUCU-3' | (SEQ ID NO: 1709) |
| MET-3832 21 nt Target: | 5'-GCCAAAGGCAUGAAAUAUCUU-3' | (SEQ ID NO: 1710) |
| MET-3833 21 nt Target: | 5'-CCAAAGGCAUGAAAUAUCUUG-3' | (SEQ ID NO: 1711) |
| MET-3834 21 nt Target: | 5'-CAAAGGCAUGAAAUAUCUUGC-3' | (SEQ ID NO: 1712) |
| MET-3854 21 nt Target: | 5'-CAAGCAAAAGUUUGUCCACA-3' | (SEQ ID NO: 1713) |
| MET-3855 21 nt Target: | 5'-AAGCAAAAGUUUGUCCACAG-3' | (SEQ ID NO: 1714) |
| MET-3856 21 nt Target: | 5'-AGCAAAAGUUUGUCCACAGA-3' | (SEQ ID NO: 1715) |
| MET-3857 21 nt Target: | 5'-GCAAAAGUUUGUCCACAGAG-3' | (SEQ ID NO: 1716) |
| MET-3858 21 nt Target: | 5'-CAAAAGUUUGUCCACAGAGA-3' | (SEQ ID NO: 1717) |
| MET-3859 21 nt Target: | 5'-AAAAGUUUGUCCACAGAGAC-3' | (SEQ ID NO: 1718) |
| MET-3860 21 nt Target: | 5'-AAAGUUUGUCCACAGAGACU-3' | (SEQ ID NO: 1719) |
| MET-3861 21 nt Target: | 5'-AAGUUUGUCCACAGAGACUU-3' | (SEQ ID NO: 1720) |
| MET-3877 21 nt Target: | 5'-GACUUGGCUGCAAGAAACUGU-3' | (SEQ ID NO: 1721) |
| MET-3879 21 nt Target: | 5'-CUUGGCUGCAAGAAACUGUAU-3' | (SEQ ID NO: 1722) |
| MET-3880 21 nt Target: | 5'-UUGGCUGCAAGAAACUGUAUG-3' | (SEQ ID NO: 1723) |
| MET-3881 21 nt Target: | 5'-UGGCUGCAAGAAACUGUAUGC-3' | (SEQ ID NO: 1724) |
| MET-3882 21 nt Target: | 5'-GGCUGCAAGAAACUGUAUGCU-3' | (SEQ ID NO: 1725) |
| MET-3917 21 nt Target: | 5'-CAGUCAAGGUUGCUGAUUUUG-3' | (SEQ ID NO: 1726) |
| MET-3922 21 nt Target: | 5'-AAGGUUGCUGAUUUUGGUCUU-3' | (SEQ ID NO: 1727) |
| MET-3924 21 nt Target: | 5'-GGUUGCUGAUUUUGGUCUUGC-3' | (SEQ ID NO: 1728) |
| MET-3935 21 nt Target: | 5'-UUGGUCUUGCCAGAGACAUGU-3' | (SEQ ID NO: 1729) |
| MET-3936 21 nt Target: | 5'-UGGUCUUGCCAGAGACAUGUA-3' | (SEQ ID NO: 1730) |
| MET-3997 21 nt Target: | 5'-AAGCUGCCAGUGAAGUGGAUG-3' | (SEQ ID NO: 1731) |
| MET-3998 21 nt Target: | 5'-AGCUGCCAGUGAAGUGGAUGG-3' | (SEQ ID NO: 1732) |
| MET-4009 21 nt Target: | 5'-AAGUGGAUGGCUUUGGAAAGU-3' | (SEQ ID NO: 1733) |
| MET-4011 21 nt Target: | 5'-GUGGAUGGCUUUGGAAAGUCU-3' | (SEQ ID NO: 1734) |
| MET-4018 21 nt Target: | 5'-GCUUUGGAAAGUCUGCAAACU-3' | (SEQ ID NO: 1735) |
| MET-4069 21 nt Target: | 5'-UCCUUUGGCGUGCUCCUCUGG-3' | (SEQ ID NO: 1736) |

TABLE 6-continued

DsiRNA Target Sequences (21mers) In MET mRNA

| | | | |
|---|---|---|---|
| MET-4071 21 nt Target: | 5'-CUUUGGCGUGCUCCUCUGGGA-3' | (SEQ ID NO: 1737) |
| MET-4072 21 nt Target: | 5'-UUUGGCGUGCUCCUCUGGGAG-3' | (SEQ ID NO: 1738) |
| MET-4073 21 nt Target: | 5'-UUGGCGUGCUCCUCUGGGAGC-3' | (SEQ ID NO: 1739) |
| MET-4074 21 nt Target: | 5'-UGGCGUGCUCCUCUGGGAGCU-3' | (SEQ ID NO: 1740) |
| MET-4319 21 nt Target: | 5'-AUGUGAACGCUACUUAUGUGA-3' | (SEQ ID NO: 1741) |
| MET-4320 21 nt Target: | 5'-UGUGAACGCUACUUAUGUGAA-3' | (SEQ ID NO: 1742) |
| MET-4367 21 nt Target: | 5'-CUCUGUUGUCAUCAGAAGAUA-3' | (SEQ ID NO: 1743) |
| MET-4523 21 nt Target: | 5'-CUUUGCUCUUGCCAAAAUUGC-3' | (SEQ ID NO: 1744) |
| MET-4559 21 nt Target: | 5'-GUAUUGUUAUUUAAAUUACUG-3' | (SEQ ID NO: 1745) |
| MET-4575 21 nt Target: | 5'-UACUGGAUUCUAAGGAAUUUC-3' | (SEQ ID NO: 1746) |
| MET-4576 21 nt Target: | 5'-ACUGGAUUCUAAGGAAUUUCU-3' | (SEQ ID NO: 1747) |
| MET-4703 21 nt Target: | 5'-UGGGUUGAAUUUUUUAAAAAU-3' | (SEQ ID NO: 1748) |
| MET-4935 21 nt Target: | 5'-GUAAACAUUCCCUUUUAAAUG-3' | (SEQ ID NO: 1749) |
| MET-4947 21 nt Target: | 5'-UUUUAAAUGUUUGUUUGUUUU-3' | (SEQ ID NO: 1750) |
| MET-4974 21 nt Target: | 5'-CAGGAUCUCACUCUGUUGCCA-3' | (SEQ ID NO: 1751) |
| MET-4976 21 nt Target: | 5'-GGAUCUCACUCUGUUGCCAGG-3' | (SEQ ID NO: 1752) |
| MET-4980 21 nt Target: | 5'-CUCACUCUGUUGCCAGGGCUG-3' | (SEQ ID NO: 1753) |
| MET-4982 21 nt Target: | 5'-CACUCUGUUGCCAGGGCUGUA-3' | (SEQ ID NO: 1754) |
| MET-4986 21 nt Target: | 5'-CUGUUGCCAGGGCUGUAGUGC-3' | (SEQ ID NO: 1755) |
| MET-4996 21 nt Target: | 5'-GGCUGUAGUGCAGUGGUGUGA-3' | (SEQ ID NO: 1756) |
| MET-5003 21 nt Target: | 5'-GUGCAGUGGUGUGAUCAUAGC-3' | (SEQ ID NO: 1757) |
| MET-5094 21 nt Target: | 5'-CCGGCUAAUUUUUGUAUUUUU-3' | (SEQ ID NO: 1758) |
| MET-5234 21 nt Target: | 5'-CCUUAUAAAUUUUUGUAUAGA-3' | (SEQ ID NO: 1759) |
| MET-5265 21 nt Target: | 5'-GUUGGAAGAAUAUUUAUAGGC-3' | (SEQ ID NO: 1760) |
| MET-5313 21 nt Target: | 5'-CACACAAAACAUGUUUAUAAA-3' | (SEQ ID NO: 1761) |
| MET-5357 21 nt Target: | 5'-AUGACAUUAAGAAAAUUUGUA-3' | (SEQ ID NO: 1762) |
| MET-5479 21 nt Target: | 5'-UUGUGUGUAUUUUUUAAAUG-3' | (SEQ ID NO: 1763) |
| MET-5548 21 nt Target: | 5'-AACUCAGCAUGUUUGUAAAGC-3' | (SEQ ID NO: 1764) |
| MET-5634 21 nt Target: | 5'-UGGAUGGAUUGAAAAGAUUAG-3' | (SEQ ID NO: 1765) |
| MET-5847 21 nt Target: | 5'-AUUCUGUGGAAUUUUGUGCUU-3' | (SEQ ID NO: 1766) |
| MET-5848 21 nt Target: | 5'-UUCUGUGGAAUUUUGUGCUUG-3' | (SEQ ID NO: 1767) |
| MET-5850 21 nt Target: | 5'-CUGUGGAAUUUUGUGCUUGCU-3' | (SEQ ID NO: 1768) |
| MET-5853 21 nt Target: | 5'-UGGAAUUUUGUGCUUGCUACU-3' | (SEQ ID NO: 1769) |
| MET-5856 21 nt Target: | 5'-AAUUUUGUGCUUGCUACUGUA-3' | (SEQ ID NO: 1770) |
| MET-5858 21 nt Target: | 5'-UUUUGUGCUUGCUACUGUAUA-3' | (SEQ ID NO: 1771) |
| MET-5859 21 nt Target: | 5'-UUUGUGCUUGCUACUGUAUAG-3' | (SEQ ID NO: 1772) |
| MET-5860 21 nt Target: | 5'-UUGUGCUUGCUACUGUAUAGU-3' | (SEQ ID NO: 1773) |
| MET-5861 21 nt Target: | 5'-UGUGCUUGCUACUGUAUAGUG-3' | (SEQ ID NO: 1774) |
| MET-5862 21 nt Target: | 5'-GUGCUUGCUACUGUAUAGUGC-3' | (SEQ ID NO: 1775) |

TABLE 6-continued

DsiRNA Target Sequences (21mers) In MET mRNA

| | | |
|---|---|---|
| MET-5864 21 nt Target: | 5'-GCUUGCUACUGUAUAGUGCAU-3' | (SEQ ID NO: 1776) |
| MET-5866 21 nt Target: | 5'-UUGCUACUGUAUAGUGCAUGU-3' | (SEQ ID NO: 1777) |
| MET-5867 21 nt Target: | 5'-UGCUACUGUAUAGUGCAUGUG-3' | (SEQ ID NO: 1778) |
| MET-5868 21 nt Target: | 5'-GCUACUGUAUAGUGCAUGUGG-3' | (SEQ ID NO: 1779) |
| MET-5919 21 nt Target: | 5'-UAAACAUUUAAAGUGUUAUAU-3' | (SEQ ID NO: 1780) |
| MET-5946 21 nt Target: | 5'-UAAAAAUGUUUAUUUUUAAUG-3' | (SEQ ID NO: 1781) |
| MET-5947 21 nt Target: | 5'-AAAAAUGUUUAUUUUUAAUGA-3' | (SEQ ID NO: 1782) |
| MET-5948 21 nt Target: | 5'-AAAAUGUUUAUUUUUAAUGAU-3' | (SEQ ID NO: 1783) |
| MET-6002 21 nt Target: | 5'-GCACUGUGAACAUUUUAGAAA-3' | (SEQ ID NO: 1784) |
| MET-6075 21 nt Target: | 5'-GCGAUAAGGAAAUGUACUGAU-3' | (SEQ ID NO: 1785) |
| MET-6076 21 nt Target: | 5'-CGAUAAGGAAAUGUACUGAUU-3' | (SEQ ID NO: 1786) |
| MET-6077 21 nt Target: | 5'-GAUAAGGAAAUGUACUGAUUG-3' | (SEQ ID NO: 1787) |
| MET-6078 21 nt Target: | 5'-AUAAGGAAAUGUACUGAUUGC-3' | (SEQ ID NO: 1788) |
| MET-6079 21 nt Target: | 5'-UAAGGAAAUGUACUGAUUGCC-3' | (SEQ ID NO: 1789) |
| MET-6080 21 nt Target: | 5'-AAGGAAAUGUACUGAUUGCCA-3' | (SEQ ID NO: 1790) |
| MET-6124 21 nt Target: | 5'-AUCAGGACUUGAAGCCAAGGG-3' | (SEQ ID NO: 1791) |
| MET-6125 21 nt Target: | 5'-UCAGGACUUGAAGCCAAGGGU-3' | (SEQ ID NO: 1792) |
| MET-6126 21 nt Target: | 5'-CAGGACUUGAAGCCAAGGGUU-3' | (SEQ ID NO: 1793) |
| MET-6127 21 nt Target: | 5'-AGGACUUGAAGCCAAGGGUUA-3' | (SEQ ID NO: 1794) |
| MET-6128 21 nt Target: | 5'-GGACUUGAAGCCAAGGGUUAA-3' | (SEQ ID NO: 1795) |
| MET-6307 21 nt Target: | 5'-UGCCGUUUCAUAAAUGUAAUA-3' | (SEQ ID NO: 1796) |
| MET-6520 21 nt Target: | 5'-UUUGCUAUUUAUAAACUUGUC-3' | (SEQ ID NO: 1797) |
| MET-6599 21 nt Target: | 5'-ACUUGUCACUGCCUAUACCUG-3' | (SEQ ID NO: 1798) |
| MET-6600 21 nt Target: | 5'-CUUGUCACUGCCUAUACCUGC-3' | (SEQ ID NO: 1799) |
| MET-6601 21 nt Target: | 5'-UUGUCACUGCCUAUACCUGCA-3' | (SEQ ID NO: 1800) |
| MET-m65 21 nt Target: | 5'-CGGCCUCGCCGCCCGCAGCGU-3' | (SEQ ID NO: 2809) |
| MET-m102 21 nt Target: | 5'-CUGUGCGGAGCCAGAUGCUGG-3' | (SEQ ID NO: 2810) |
| MET-m106 21 nt Target: | 5'-GCGGAGCCAGAUGCUGGGCGA-3' | (SEQ ID NO: 2811) |
| MET-m114 21 nt Target: | 5'-AGAUGCUGGGCGACCGCUGAC-3' | (SEQ ID NO: 2812) |
| MET-m115 21 nt Target: | 5'-GAUGCUGGGCGACCGCUGACU-3' | (SEQ ID NO: 2813) |
| MET-m117 21 nt Target: | 5'-UGCUGGGCGACCGCUGACUCG-3' | (SEQ ID NO: 2814) |
| MET-m167 21 nt Target: | 5'-CCCAGCCGGCUGACUUCGGCG-3' | (SEQ ID NO: 2815) |
| MET-m169 21 nt Target: | 5'-CAGCCGGCUGACUUCGGCGCC-3' | (SEQ ID NO: 2816) |
| MET-m171 21 nt Target: | 5'-GCCGGCUGACUUCGGCGCCGC-3' | (SEQ ID NO: 2817) |
| MET-m335 21 nt Target: | 5'-AAGCUGACGGUGUAGCAGAAC-3' | (SEQ ID NO: 2818) |
| MET-m336 21 nt Target: | 5'-AGCUGACGGUGUAGCAGAACG-3' | (SEQ ID NO: 2819) |
| MET-m400 21 nt Target: | 5'-CUGGCACCUGGCAUUCUGGUG-3' | (SEQ ID NO: 2820) |
| MET-m402 21 nt Target: | 5'-GGCACCUGGCAUUCUGGUGCU-3' | (SEQ ID NO: 2821) |
| MET-m403 21 nt Target: | 5'-GCACCUGGCAUUCUGGUGCUG-3' | (SEQ ID NO: 2822) |

TABLE 6-continued

DsiRNA Target Sequences (21mers) In MET mRNA

| | | |
|---|---|---|
| MET-m413 21 nt Target: | 5'-UUCUGGUGCUGCUGUUGUCCU-3' | (SEQ ID NO: 2823) |
| MET-m415 21 nt Target: | 5'-CUGGUGCUGCUGUUGUCCUUG-3' | (SEQ ID NO: 2824) |
| MET-m416 21 nt Target: | 5'-UGGUGCUGCUGUUGUCCUUGG-3' | (SEQ ID NO: 2825) |
| MET-m419 21 nt Target: | 5'-UGCUGCUGUUGUCCUUGGUGC-3' | (SEQ ID NO: 2826) |
| MET-m1221 21 nt Target: | 5'-CUGUUCCGUAGACUCUGGGUU-3' | (SEQ ID NO: 2827) |
| MET-m1561 21 nt Target: | 5'-GAGCACUGUUUCAAUAGGACC-3' | (SEQ ID NO: 2828) |
| MET-m1590 21 nt Target: | 5'-AAACUCUUCCGGCUGUGAAGC-3' | (SEQ ID NO: 2829) |
| MET-m1592 21 nt Target: | 5'-ACUCUUCCGGCUGUGAAGCGC-3' | (SEQ ID NO: 2830) |
| MET-m1636 21 nt Target: | 5'-UUUACCACGGCUUUGCAGCGC-3' | (SEQ ID NO: 2831) |
| MET-m1638 21 nt Target: | 5'-UACCACGGCUUUGCAGCGCGU-3' | (SEQ ID NO: 2832) |
| MET-m1641 21 nt Target: | 5'-CACGGCUUUGCAGCGCGUCGA-3' | (SEQ ID NO: 2833) |
| MET-m1643 21 nt Target: | 5'-CGGCUUUGCAGCGCGUCGACU-3' | (SEQ ID NO: 2834) |
| MET-m1644 21 nt Target: | 5'-GGCUUUGCAGCGCGUCGACUU-3' | (SEQ ID NO: 2835) |
| MET-m1645 21 nt Target: | 5'-GCUUUGCAGCGCGUCGACUUA-3' | (SEQ ID NO: 2836) |
| MET-m1646 21 nt Target: | 5'-CUUUGCAGCGCGUCGACUUAU-3' | (SEQ ID NO: 2837) |
| MET-m1653 21 nt Target: | 5'-GCGCGUCGACUUAUUCAUGGG-3' | (SEQ ID NO: 2838) |
| MET-m1757 21 nt Target: | 5'-GUCGCUUCAUGCAGGUGGUGC-3' | (SEQ ID NO: 2839) |
| MET-m1769 21 nt Target: | 5'-AGGUGGUGCUCUCUCGAACAG-3' | (SEQ ID NO: 2840) |
| MET-m1771 21 nt Target: | 5'-GUGGUGCUCUCUCGAACAGCA-3' | (SEQ ID NO: 2841) |
| MET-m2188 21 nt Target: | 5'-CUGCUUGGCAACGAGAGCUGU-3' | (SEQ ID NO: 2842) |
| MET-m2779 21 nt Target: | 5'-UGCACUACUCCUUCACUGAAA-3' | (SEQ ID NO: 2843) |
| MET-m3113 21 nt Target: | 5'-AGCAAGCAGUCUCUUCAACUG-3' | (SEQ ID NO: 2844) |
| MET-m3114 21 nt Target: | 5'-GCAAGCAGUCUCUUCAACUGU-3' | (SEQ ID NO: 2845) |
| MET-m3119 21 nt Target: | 5'-CAGUCUCUUCAACUGUUCUUG-3' | (SEQ ID NO: 2846) |
| MET-m3573 21 nt Target: | 5'-UCAGCACGUAGUGAUUGGACC-3' | (SEQ ID NO: 2847) |
| MET-m3588 21 nt Target: | 5'-UGGACCCAGCAGCCUGAUUGU-3' | (SEQ ID NO: 2848) |
| MET-m4025 21 nt Target: | 5'-CUGUCAAGGUUGCUGAUUUCG-3' | (SEQ ID NO: 2849) |
| MET-m4032 21 nt Target: | 5'-GGUUGCUGAUUUCGGUCUGC-3' | (SEQ ID NO: 2850) |
| MET-m4100 21 nt Target: | 5'-GUGCCAAGCUACCAGUAAAGU-3' | (SEQ ID NO: 2851) |
| MET-m4104 21 nt Target: | 5'-CAAGCUACCAGUAAAGUGGAU-3' | (SEQ ID NO: 2852) |
| MET-m4105 21 nt Target: | 5'-AAGCUACCAGUAAAGUGGAUG-3' | (SEQ ID NO: 2853) |
| MET-m4179 21 nt Target: | 5'-CUUUGGUGUGCUCCUCUGGGA-3' | (SEQ ID NO: 2854) |
| MET-m4180 21 nt Target: | 5'-UUUGGUGUGCUCCUCUGGGAG-3' | (SEQ ID NO: 2855) |
| MET-m4182 21 nt Target: | 5'-UGGUGUGCUCCUCUGGGAGCU-3' | (SEQ ID NO: 2856) |
| MET-m4639 21 nt Target: | 5'-UUUUGUUUUGUUUUUGUUUU-3' | (SEQ ID NO: 2857) |
| MET-m4640 21 nt Target: | 5'-UUUGUUUUGUUUUUGUUUUG-3' | (SEQ ID NO: 2858) |
| MET-m4641 21 nt Target: | 5'-UUGUUUUGUUUUUGUUUUGC-3' | (SEQ ID NO: 2859) |
| MET-m4642 21 nt Target: | 5'-UGUUUUGUUUUUGUUUUGCU-3' | (SEQ ID NO: 2860) |
| MET-m4643 21 nt Target: | 5'-GUUUUGUUUUUGUUUUGCUU-3' | (SEQ ID NO: 2861) |

TABLE 6-continued

| DsiRNA Target Sequences (21mers) In MET mRNA | | |
|---|---|---|
| MET-m4645 21 nt Target: | 5'-UUUGUUUUUGUUUUGCUUUU-3' | (SEQ ID NO: 2862) |
| MET-m4646 21 nt Target: | 5'-UUGUUUUUGUUUUGCUUUUG-3' | (SEQ ID NO: 2863) |
| MET-m4647 21 nt Target: | 5'-UGUUUUUGUUUUGCUUUUGC-3' | (SEQ ID NO: 2864) |
| MET-m4648 21 nt Target: | 5'-GUUUUUGUUUUGCUUUUGCG-3' | (SEQ ID NO: 2865) |
| MET-m4649 21 nt Target: | 5'-UUUUUGUUUUGCUUUUGCGG-3' | (SEQ ID NO: 2866) |
| MET-m4650 21 nt Target: | 5'-UUUUGUUUUGCUUUUGCGGU-3' | (SEQ ID NO: 2867) |
| MET-m4651 21 nt Target: | 5'-UUUUGUUUUGCUUUUGCGGUA-3' | (SEQ ID NO: 2868) |
| MET-m4652 21 nt Target: | 5'-UUUGUUUUGCUUUUGCGGUAA-3' | (SEQ ID NO: 2869) |
| MET-m4653 21 nt Target: | 5'-UUGUUUUGCUUUUGCGGUAAC-3' | (SEQ ID NO: 2870) |
| MET-m4654 21 nt Target: | 5'-UGUUUUGCUUUUGCGGUAACU-3' | (SEQ ID NO: 2871) |
| MET-m4655 21 nt Target: | 5'-GUUUUGCUUUUGCGGUAACUG-3' | (SEQ ID NO: 2872) |
| MET-m4656 21 nt Target: | 5'-UUUUGCUUUUGCGGUAACUGC-3' | (SEQ ID NO: 2873) |
| MET-m4659 21 nt Target: | 5'-UGCUUUUGCGGUAACUGCACC-3' | (SEQ ID NO: 2874) |
| MET-m5255 21 nt Target: | 5'-AACCCAGCUGUUUAGCAAGGA-3' | (SEQ ID NO: 2875) |
| MET-m5259 21 nt Target: | 5'-CAGCUGUUUAGCAAGGAGUGU-3' | (SEQ ID NO: 2876) |
| MET-m5835 21 nt Target: | 5'-UUUUGUGCUUACUACUGUAUA-3' | (SEQ ID NO: 2877) |
| MET-m5836 21 nt Target: | 5'-UUUGUGCUUACUACUGUAUAG-3' | (SEQ ID NO: 2878) |
| MET-m5837 21 nt Target: | 5'-UUGUGCUUACUACUGUAUAGU-3' | (SEQ ID NO: 2879) |
| MET-m5839 21 nt Target: | 5'-GUGCUUACUACUGUAUAGUGC-3' | (SEQ ID NO: 2880) |

TABLE 7

| Selected Human Anti-MET "Blunt/Fray" DsiRNAs | |
|---|---|
| 5'-GGCGCGGAGCGCGCGUGUGGUCCUU$^A_A$-3' | (SEQ ID NO: 1801) |
| 3'-CCGCGCCUCGCGCGCACACCAGGAA$_C^G$-5' | (SEQ ID NO: 361) |
| MET-136 Target: 5'-GGCGCGGAGCGCGCGTGTGGTCCTTGC-3' | (SEQ ID NO: 721) |
| 5'-GCGCGGAGCGCGCGUGUGGUCCUUG$^A_A$-3' | (SEQ ID NO: 1802) |
| 3'-CGCGCCUCGCGCGCACACCAGGAAC$_C^G$-5' | (SEQ ID NO: 362) |
| MET-137 Target: 5'-GCGCGGAGCGCGCGTGTGGTCCTTGCG-3' | (SEQ ID NO: 722) |
| 5'-CGCGGAGCGCGCGUGUGGUCCUUGC$^A_A$-3' | (SEQ ID NO: 1803) |
| 3'-GCGCCUCGCGCGCACACCAGGAACG$_C^G$-5' | (SEQ ID NO: 363) |
| MET-138 Target: 5'-CGCGGAGCGCGCGTGTGGTCCTTGCGC-3' | (SEQ ID NO: 723) |
| 5'-CGGAGCGCGCGUGUGGUCCUUGCGC$^A_A$-3' | (SEQ ID NO: 1804) |
| 3'-GCCUCGCGCGCACACCAGGAACGCG$_C^G$-5' | (SEQ ID NO: 364) |
| MET-140 Target: 5'-CGGAGCGCGCGTGTGGTCCTTGCGCCG-3' | (SEQ ID NO: 724) |
| 5'-GAGCGCGCGUGUGGUCCUUGCGCCG$^C_A$-3' | (SEQ ID NO: 1805) |
| 3'-CUCGCGCGCACACCAGGAACGCGGC$_A^G$-5' | (SEQ ID NO: 365) |
| MET-142 Target: 5'-GAGCGCGCGTGTGGTCCTTGCGCCGCT-3' | (SEQ ID NO: 725) |
| 5'-AGCGCGCGUGUGGUCCUUGCGCCGC$^A_C$-3' | (SEQ ID NO: 1806) |
| 3'-UCGCGCGCACACCAGGAACGCGGCG$_C^A$-5' | (SEQ ID NO: 366) |
| MET-143 Target: 5'-AGCGCGCGTGTGGTCCTTGCGCCGCTG-3' | (SEQ ID NO: 726) |

TABLE 7-continued

Selected Human Anti-MET "Blunt/Fray" DsiRNAs

```
              5'-CGCGCGUGUGGUCCUUGCGCCGCUG C A-3'   (SEQ ID NO: 1807)
              3'-GCGCGCACACCAGGAACGCGGCGAC U G-5'   (SEQ ID NO: 367)

MET-145 Target: 5'-CGCGCGTGTGGTCCTTGCGCCGCTGAC-3'    (SEQ ID NO: 727)

5'-GCGCGUGUGGUCCUUGCGCCGCUGA A C-3'   (SEQ ID NO: 1808)
              3'-CGCGCACACCAGGAACGCGGCGACU G A-5'   (SEQ ID NO: 368)

MET-146 Target: 5'-GCGCGTGTGGTCCTTGCGCCGCTGACT-3'    (SEQ ID NO: 728)

5'-GCGUGUGGUCCUUGCGCCGCUGACU C A-3'   (SEQ ID NO: 1809)
              3'-CGCACACCAGGAACGCGGCGACUGA A G-5'   (SEQ ID NO: 369)

MET-148 Target: 5'-GCGTGTGGTCCTTGCGCCGCTGACTTC-3'    (SEQ ID NO: 729)

5'-GUCCUUGCGCCGCUGACUUCUCCAC C A-3'   (SEQ ID NO: 1810)
              3'-CAGGAACGCGGCGACUGAAGAGGUG A C-5'   (SEQ ID NO: 370)

MET-155 Target: 5'-GTCCTTGCGCCGCTGACTTCTCCACTG-3'    (SEQ ID NO: 730)

5'-UUGCGCCGCUGACUUCUCCACUGGU C A-3'   (SEQ ID NO: 1811)
              3'-AACGCGGCGACUGAAGAGGUGACCA A G-5'   (SEQ ID NO: 371)

MET-159 Target: 5'-TTGCGCCGCTGACTTCTCCACTGGTTC-3'    (SEQ ID NO: 731)

5'-CGCUGUGCUUGCACCUGGCAUCCUC A C-3'   (SEQ ID NO: 1812)
              3'-GCGACACGAACGUGGACCGUAGGAG C A-5'   (SEQ ID NO: 372)

MET-225 Target: 5'-CGCTGTGCTTGCACCTGGCATCCTCGT-3'    (SEQ ID NO: 732)

5'-CUGUGCUUGCACCUGGCAUCCUCGU A A-3'   (SEQ ID NO: 1813)
              3'-GACACGAACGUGGACCGUAGGAGCA C G-5'   (SEQ ID NO: 373)

MET-227 Target: 5'-CTGTGCTTGCACCTGGCATCCTCGTGC-3'    (SEQ ID NO: 733)

5'-UGCACCUGGCAUCCUCGUGCUCCUG C C-3'   (SEQ ID NO: 1814)
              3'-ACGUGGACCGUAGGAGCACGAGGAC A A-5'   (SEQ ID NO: 374)

MET-234 Target: 5'-TGCACCTGGCATCCTCGTGCTCCTGTT-3'    (SEQ ID NO: 734)

5'-UCCUCGUGCUCCUGUUUACCUUGGU A A-3'   (SEQ ID NO: 1815)
              3'-AGGAGCACGAGGACAAAUGGAACCA C G-5'   (SEQ ID NO: 375)

MET-245 Target: 5'-TCCTCGTGCTCCTGTTTACCTTGGTGC-3'    (SEQ ID NO: 735)

5'-UCGUGCUCCUGUUUACCUUGGUGCA A C-3'   (SEQ ID NO: 1816)
              3'-AGCACGAGGACAAAUGGAACCACGU C U-5'   (SEQ ID NO: 376)

MET-248 Target: 5'-TCGTGCTCCTGTTTACCTTGGTGCAGA-3'    (SEQ ID NO: 736)

5'-CGUGCUCCUGUUUACCUUGGUGCAG C A-3'   (SEQ ID NO: 1817)
              3'-GCACGAGGACAAAUGGAACCACGUC U C-5'   (SEQ ID NO: 377)

MET-249 Target: 5'-CGTGCTCCTGTTTACCTTGGTGCAGAG-3'    (SEQ ID NO: 737)

5'-GCCACUAACUACAUUUAUGUUUUAA C C-3'   (SEQ ID NO: 1818)
              3'-CGGUGAUUGAUGUAAAUACAAAAUU U A-5'   (SEQ ID NO: 378)

MET-409 Target: 5'-GCCACTAACTACATTTATGTTTTAAAT-3'    (SEQ ID NO: 738)

5'-CUAACUACAUUUAUGUUUUAAAUGA A A-3'   (SEQ ID NO: 1819)
              3'-GAUUGAUGUAAAUACAAAAUUUACU C C-5'   (SEQ ID NO: 379)

MET-413 Target: 5'-CTAACTACATTTATGTTTTAAATGAGG-3'    (SEQ ID NO: 739)
```

TABLE 7-continued

Selected Human Anti-MET "Blunt/Fray" DsiRNAs

```
                5'-UACUACAUUUAUGUUUUAAAUGAGA C-3'   (SEQ ID NO: 1820)
                3'-AUUGAUGUAAAUACAAAAUUUACUC C -5'   (SEQ ID NO: 380)
                                                U

MET-414 Target: 5'-TAACTACATTTATGTTTTAAATGAGGA-3'   (SEQ ID NO: 740)

5'-AACUACAUUUAUGUUUUAAAUGAGG C C-3'  (SEQ ID NO: 1821)
                3'-UUGAUGUAAAUACAAAAUUUACUCC U -5'   (SEQ ID NO: 381)
                                                U

MET-415 Target: 5'-AACTACATTTATGTTTTAAATGAGGAA-3'  (SEQ ID NO: 741)

5'-ACUACAUUUAUGUUUUAAAUGAGGA C A-3'  (SEQ ID NO: 1822)
                3'-UGAUGUAAAUACAAAAUUUACUCCU U -5'   (SEQ ID NO: 382)
                                                C

MET-416 Target: 5'-ACTACATTTATGTTTTAAATGAGGAAG-3'  (SEQ ID NO: 742)

5'-CUACAUUUAUGUUUUAAAUGAGGAA A C-3'  (SEQ ID NO: 1823)
                3'-GAUGUAAAUACAAAAUUUACUCCUU C -5'   (SEQ ID NO: 383)
                                                 U

MET-417 Target: 5'-CTACATTTATGTTTTAAATGAGGAAGA-3'  (SEQ ID NO: 743)

5'-GCUGGAACACCCAGAUUGUUUCCCA C A-3'  (SEQ ID NO: 1824)
                3'-CGACCUUGUGGGUCUAACAAAGGGU A -5'   (SEQ ID NO: 384)
                                                 C

MET-480 Target: 5'-GCTGGAACACCCAGATTGTTTCCCATG-3'  (SEQ ID NO: 744)

5'-CAGGACUGCAGCAGCAAAGCCAAUU C C-3'  (SEQ ID NO: 1825)
                3'-GUCCUGACGUCGUCGUUUCGGUUAA A -5'   (SEQ ID NO: 385)
                                                 U

MET-508 Target: 5'-CAGGACTGCAGCAGCAAAGCCAATTTA-3'  (SEQ ID NO: 745)

5'-AGGACUGCAGCAGCAAAGCCAAUUU C C-3'  (SEQ ID NO: 1826)
                3'-UCCUGACGUCGUCGUUUCGGUUAAA U -5'   (SEQ ID NO: 386)
                                                 A

MET-509 Target: 5'-AGGACTGCAGCAGCAAAGCCAATTTAT-3'  (SEQ ID NO: 746)

5'-GGACUGCAGCAGCAAAGCCAAUUUA C A-3'  (SEQ ID NO: 1827)
                3'-CCUGACGUCGUCGUUUCGGUUAAAU A -5'   (SEQ ID NO: 387)
                                                 G

MET-510 Target: 5'-GGACTGCAGCAGCAAAGCCAATTTATC-3'  (SEQ ID NO: 747)

5'-GACUGCAGCAGCAAAGCCAAUUUAU A C-3'  (SEQ ID NO: 1828)
                3'-CUGACGUCGUCGUUUCGGUUAAAUA C -5'   (SEQ ID NO: 388)
                                                 G

MET-511 Target: 5'-GACTGCAGCAGCAAAGCCAATTTATCA-3'  (SEQ ID NO: 748)

5'-ACUGCAGCAGCAAAGCCAAUUUAUC C A-3'  (SEQ ID NO: 1829)
                3'-UGACGUCGUCGUUUCGGUUAAAUAG U -5'   (SEQ ID NO: 389)
                                                 C

MET-512 Target: 5'-ACTGCAGCAGCAAAGCCAATTTATCAG-3'  (SEQ ID NO: 749)

5'-CCUACUAUGAUGAUCAACUCAUUAG A C-3'  (SEQ ID NO: 1830)
                3'-GGAUGAUACUACUAGUUGAGUAAUC G -5'   (SEQ ID NO: 390)
                                                 A

MET-584 Target: 5'-CCTACTATGATGATCAACTCATTAGCT-3'  (SEQ ID NO: 750)

5'-CUACUAUGAUGAUCAACUCAUUAGC C A-3'  (SEQ ID NO: 1831)
                3'-GAUGAUACUACUAGUUGAGUAAUCG A -5'   (SEQ ID NO: 391)
                                                 C

MET-585 Target: 5'-CTACTATGATGATCAACTCATTAGCTG-3'  (SEQ ID NO: 751)

5'-UACUAUGAUGAUCAACUCAUUAGCU A C-3'  (SEQ ID NO: 1832)
                3'-AUGAUACUACUAGUUGAGUAAUCGA C -5'   (SEQ ID NO: 392)
                                                 A

MET-586 Target: 5'-TACTATGATGATCAACTCATTAGCTGT-3'  (SEQ ID NO: 752)
```

TABLE 7-continued

Selected Human Anti-MET "Blunt/Fray" DsiRNAs

```
            5'-ACUAUGAUGAUCAACUCAUUAGCUG C A -3'  (SEQ ID NO: 1833)
            3'-UGAUACUACUAGUUGAGUAAUCGAC A C -5'  (SEQ ID NO: 393)

MET-587 Target: 5'-ACTATGATGATCAACTCATTAGCTGTG-3'  (SEQ ID NO: 753)

5'-CUAUGAUGAUCAACUCAUUAGCUGU A A -3'  (SEQ ID NO: 1834)
            3'-GAUACUACUAGUUGAGUAAUCGACA C C -5'  (SEQ ID NO: 394)

MET-588 Target: 5'-CTATGATGATCAACTCATTAGCTGTGG-3'  (SEQ ID NO: 754)

5'-UAUGAUGAUCAACUCAUUAGCUGUG A A -3'  (SEQ ID NO: 1835)
            3'-AUACUACUAGUUGAGUAAUCGACAC C G -5'  (SEQ ID NO: 395)

MET-589 Target: 5'-TATGATGATCAACTCATTAGCTGTGGC-3'  (SEQ ID NO: 755)

5'-AUGAUGAUCAACUCAUUAGCUGUGG A C -3'  (SEQ ID NO: 1836)
            3'-UACUACUAGUUGAGUAAUCGACACC G U -5'  (SEQ ID NO: 396)

MET-590 Target: 5'-ATGATGATCAACTCATTAGCTGTGGCA-3'  (SEQ ID NO: 756)

5'-UGAUGAUCAACUCAUUAGCUGUGGC C A -3'  (SEQ ID NO: 1837)
            3'-ACUACUAGUUGAGUAAUCGACACCG U C -5'  (SEQ ID NO: 397)

MET-591 Target: 5'-TGATGATCAACTCATTAGCTGTGGCAG-3'  (SEQ ID NO: 757)

5'-GAUGAUCAACUCAUUAGCUGUGGCA A A -3'  (SEQ ID NO: 1838)
            3'-CUACUAGUUGAGUAAUCGACACCGU C G -5'  (SEQ ID NO: 398)

MET-592 Target: 5'-GATGATCAACTCATTAGCTGTGGCAGC-3'  (SEQ ID NO: 758)

5'-AUGAUCAACUCAUUAGCUGUGGCAG A A -3'  (SEQ ID NO: 1839)
            3'-UACUAGUUGAGUAAUCGACACCGUC G C -5'  (SEQ ID NO: 399)

MET-593 Target: 5'-ATGATCAACTCATTAGCTGTGGCAGCG-3'  (SEQ ID NO: 759)

5'-UGAUCAACUCAUUAGCUGUGGCAGC A C -3'  (SEQ ID NO: 1840)
            3'-ACUAGUUGAGUAAUCGACACCGUCG C A -5'  (SEQ ID NO: 400)

MET-594 Target: 5'-TGATCAACTCATTAGCTGTGGCAGCGT-3'  (SEQ ID NO: 760)

5'-GAUCAACUCAUUAGCUGUGGCAGCG C A -3'  (SEQ ID NO: 1841)
            3'-CUAGUUGAGUAAUCGACACCGUCGC A G -5'  (SEQ ID NO: 401)

MET-595 Target: 5'-GATCAACTCATTAGCTGTGGCAGCGTC-3'  (SEQ ID NO: 761)

5'-AUCAACUCAUUAGCUGUGGCAGCGU A C -3'  (SEQ ID NO: 1842)
            3'-UAGUUGAGUAAUCGACACCGUCGCA G U -5'  (SEQ ID NO: 402)

MET-596 Target: 5'-ATCAACTCATTAGCTGTGGCAGCGTCA-3'  (SEQ ID NO: 762)

5'-UCAACUCAUUAGCUGUGGCAGCGUC C C -3'  (SEQ ID NO: 1843)
            3'-AGUUGAGUAAUCGACACCGUCGCAG U U -5'  (SEQ ID NO: 403)

MET-597 Target: 5'-TCAACTCATTAGCTGTGGCAGCGTCAA-3'  (SEQ ID NO: 763)

5'-AAGAUGGUUUUAUGUUUUUGACGGA A A -3'  (SEQ ID NO: 1844)
            3'-UUCUACCAAAAUACAAAAACUGCCU G G -5'  (SEQ ID NO: 404)

MET-881 Target: 5'-AAGATGGTTTTATGTTTTTGACGGACC-3'  (SEQ ID NO: 764)

5'-GCCUUUGAAAGCAACAAUUUUAUUU C A -3'  (SEQ ID NO: 1845)
            3'-CGGAAACUUUCGUUGUUAAAAUAAA U G -5'  (SEQ ID NO: 405)

MET-967 Target: 5'-GCCTTTGAAAGCAACAATTTTATTTAC-3'  (SEQ ID NO: 765)
```

TABLE 7-continued

Selected Human Anti-MET "Blunt/Fray" DsiRNAs

```
                5'-AGGGAAACUCUAGAUGCUCAGACUU C C-3'   (SEQ ID NO: 1846)
                3'-UCCCUUUGAGAUCUACGAGUCUGAA A A-5'   (SEQ ID NO: 406)

MET-1009 Tar-   5'-AGGGAAACTCTAGATGCTCAGACTTTT-3'     (SEQ ID NO: 766)
get:

5'-GGGAAACUCUAGAUGCUCAGACUUU C A-3'   (SEQ ID NO: 1847)
                3'-CCCUUUGAGAUCUACGAGUCUGAAA A G-5'   (SEQ ID NO: 407)

MET-1010 Tar-   5'-GGGAAACTCTAGATGCTCAGACTTTTC-3'     (SEQ ID NO: 767)
get:

5'-GGAAACUCUAGAUGCUCAGACUUUU A C-3'   (SEQ ID NO: 1848)
                3'-CCUUUGAGAUCUACGAGUCUGAAAA G U-5'   (SEQ ID NO: 408)

MET-1011 Tar-   5'-GGAAACTCTAGATGCTCAGACTTTTCA-3'     (SEQ ID NO: 768)
get:

5'-GAAACUCUAGAUGCUCAGACUUUUC C A-3'   (SEQ ID NO: 1849)
                3'-CUUUGAGAUCUACGAGUCUGAAAAG U G-5'   (SEQ ID NO: 409)

MET-1012 Tar-   5'-GAAACTCTAGATGCTCAGACTTTTCAC-3'     (SEQ ID NO: 769)
get:

5'-AAACUCUAGAUGCUCAGACUUUUCA A C-3'   (SEQ ID NO: 1850)
                3'-UUUGAGAUCUACGAGUCUGAAAAGU G U-5'   (SEQ ID NO: 410)

MET-1013 Tar-   5'-AAACTCTAGATGCTCAGACTTTTCACA-3'     (SEQ ID NO: 770)
get:

5'-AACUCUAGAUGCUCAGACUUUUCAC C A-3'   (SEQ ID NO: 1851)
                3'-UUGAGAUCUACGAGUCUGAAAAGUG U G-5'   (SEQ ID NO: 411)

MET-1014 Tar-   5'-AACTCTAGATGCTCAGACTTTTCACAC-3'     (SEQ ID NO: 771)
get:

5'-CACACAAGAAUAAUCAGGUUCUGUU A A-3'   (SEQ ID NO: 1852)
                3'-GUGUGUUCUUAUUAGUCCAAGACAA G G-5'   (SEQ ID NO: 412)

MET-1036 Tar-   5'-CACACAAGAATAATCAGGTTCTGTTCC-3'     (SEQ ID NO: 772)
get:

5'-CACAAGAAUAAUCAGGUUCUGUUCC C C-3'   (SEQ ID NO: 1853)
                3'-GUGUUCUUAUUAGUCCAAGACAAGG U A-5'   (SEQ ID NO: 413)

MET-1038 Tar-   5'-CACAAGAATAATCAGGTTCTGTTCCAT-3'     (SEQ ID NO: 773)
get:

5'-ACAAGAAUAAUCAGGUUCUGUUCCA C C-3'   (SEQ ID NO: 1854)
                3'-UGUUCUUAUUAGUCCAAGACAAGGU A U-5'   (SEQ ID NO: 414)

MET-1039 Tar-   5'-ACAAGAATAATCAGGTTCTGTTCCATA-3'     (SEQ ID NO: 774)
get:

5'-CAAGAAUAAUCAGGUUCUGUUCCAU C C-3'   (SEQ ID NO: 1855)
                3'-GUUCUUAUUAGUCCAAGACAAGGUA U U-5'   (SEQ ID NO: 415)

MET-1040 Tar-   5'-CAAGAATAATCAGGTTCTGTTCCATAA-3'     (SEQ ID NO: 775)
get:

5'-AAGAAUAAUCAGGUUCUGUUCCAUA C C-3'   (SEQ ID NO: 1856)
                3'-UUCUUAUUAGUCCAAGACAAGGUAU U U-5'   (SEQ ID NO: 416)

MET-1041 Tar-   5'-AAGAATAATCAGGTTCTGTTCCATAAA-3'     (SEQ ID NO: 776)
get:

5'-AGAAUAAUCAGGUUCUGUUCCAUAA C A-3'   (SEQ ID NO: 1857)
                3'-UCUUAUUAGUCCAAGACAAGGUAUU U G-5'   (SEQ ID NO: 417)

MET-1042 Tar-   5'-AGAATAATCAGGTTCTGTTCCATAAAC-3'     (SEQ ID NO: 777)
get:
```

TABLE 7-continued

Selected Human Anti-MET "Blunt/Fray" DsiRNAs

```
                  5'-CUGUUCCAUAAACUCUGGAUUGCAU C A-3'    (SEQ ID NO: 1858)
                  3'-GACAAGGUAUUUGAGACCUAACGUA A G-5'    (SEQ ID NO: 418)

MET-1056 Tar-     5'-CTGTTCCATAAACTCTGGATTGCATTC-3'     (SEQ ID NO: 778)
get:

5'-CUGGAGUGUAUUCUCACAGAAAAGA A C-3'    (SEQ ID NO: 1859)
                  3'-GACCUCACAUAAGAGUGUCUUUUCU C U-5'    (SEQ ID NO: 419)

MET-1099 Tar-     5'-CTGGAGTGTATTCTCACAGAAAAGAGA-3'     (SEQ ID NO: 779)
get:

5'-AAGGAAGUGUUUAAUAUACUUCAGG A C-3'    (SEQ ID NO: 1860)
                  3'-UUCCUUCACAAAUUAUAUGAAGUCC G A-5'    (SEQ ID NO: 420)

MET-1144 Tar-     5'-AAGGAAGTGTTTAATATACTTCAGGCT-3'     (SEQ ID NO: 780)
get:

5'-UUCAGGCUGCGUAUGUCAGCAAGCC C A-3'    (SEQ ID NO: 1861)
                  3'-AAGUCCGACGCAUACAGUCGUUCGG A C-5'    (SEQ ID NO: 421)

MET-1163 Tar-     5'-TTCAGGCTGCGTATGTCAGCAAGCCTG-3'     (SEQ ID NO: 781)
get:

5'-UCGCACAAAGCAAGCCAGAUUCUGC A A-3'    (SEQ ID NO: 1862)
                  3'-AGCGUGUUUCGUUCGGUCUAAGACG G C-5'    (SEQ ID NO: 422)

MET-1250 Tar-     5'-TCGCACAAAGCAAGCCAGATTCTGCCG-3'     (SEQ ID NO: 782)
get:

5'-CGCACAAAGCAAGCCAGAUUCUGCC A C-3'    (SEQ ID NO: 1863)
                  3'-GCGUGUUUCGUUCGGUCUAAGACGG C U-5'    (SEQ ID NO: 423)

MET-1251 Tar-     5'-CGCACAAAGCAAGCCAGATTCTGCCGA-3'     (SEQ ID NO: 783)
get:

5'-GCACAAAGCAAGCCAGAUUCUGCCG C C-3'    (SEQ ID NO: 1864)
                  3'-CGUGUUUCGUUCGGUCUAAGACGGC U U-5'    (SEQ ID NO: 424)

MET-1252 Tar-     5'-GCACAAAGCAAGCCAGATTCTGCCGAA-3'     (SEQ ID NO: 784)
get:

5'-CACAAAGCAAGCCAGAUUCUGCCGA C A-3'    (SEQ ID NO: 1865)
                  3'-GUGUUUCGUUCGGUCUAAGACGGCU U G-5'    (SEQ ID NO: 425)

MET-1253 Tar-     5'-CACAAAGCAAGCCAGATTCTGCCGAAC-3'     (SEQ ID NO: 785)
get:

5'-ACAAAGCAAGCCAGAUUCUGCCGAA A A-3'    (SEQ ID NO: 1866)
                  3'-UGUUUCGUUCGGUCUAAGACGGCUU G G-5'    (SEQ ID NO: 426)

MET-1254 Tar-     5'-ACAAAGCAAGCCAGATTCTGCCGAACC-3'     (SEQ ID NO: 786)
get:

5'-AUGUGAGAUGUCUCCAGCAUUUUUA A A-3'    (SEQ ID NO: 1867)
                  3'-UACACUCUACAGAGGUCGUAAAAAU G C-5'    (SEQ ID NO: 427)

MET-1358 Tar-     5'-ATGTGAGATGTCTCCAGCATTTTTACG-3'     (SEQ ID NO: 787)
get:

5'-UGUGAGAUGUCUCCAGCAUUUUUAC A A-3'    (SEQ ID NO: 1868)
                  3'-ACACUCUACAGAGGUCGUAAAAAUG C C-5'    (SEQ ID NO: 428)

MET-1359 Tar-     5'-TGTGAGATGTCTCCAGCATTTTTACGG-3'     (SEQ ID NO: 788)
get:
```

TABLE 7-continued

Selected Human Anti-MET "Blunt/Fray" DsiRNAs

```
                5'-GUGAGAUGUCUCCAGCAUUUUUACG A^A-3'   (SEQ ID NO: 1869)
                3'-CACUCUACAGAGGUCGUAAAAAUGC C_G-5'   (SEQ ID NO: 429)

MET-1360 Tar-   5'-GTGAGATGTCTCCAGCATTTTTACGGA-3'     (SEQ ID NO: 789)
get:

5'-UGAGAUGUCUCCAGCAUUUUUACGG C^A-3'   (SEQ ID NO: 1870)
                3'-ACUCUACAGAGGUCGUAAAAAUGCC U_G-5'   (SEQ ID NO: 430)

MET-1361 Tar-   5'-TGAGATGTCTCCAGCATTTTTACGGAC-3'     (SEQ ID NO: 790)
get:

5'-GAGAUGUCUCCAGCAUUUUUACGGA A^A-3'   (SEQ ID NO: 1871)
                3'-CUCUACAGAGGUCGUAAAAAUGCCU G_G-5'   (SEQ ID NO: 431)

MET-1362 Tar-   5'-GAGATGTCTCCAGCATTTTTACGGACC-3'     (SEQ ID NO: 791)
get:

5'-AGAUGUCUCCAGCAUUUUUACGGAC A^A-3'   (SEQ ID NO: 1872)
                3'-UCUACAGAGGUCGUAAAAAUGCCUG G_G-5'   (SEQ ID NO: 432)

MET-1363 Tar-   5'-AGATGTCTCCAGCATTTTTACGGACCC-3'     (SEQ ID NO: 792)
get:

5'-GAUGUCUCCAGCAUUUUUACGGACC A^C-3'   (SEQ ID NO: 1873)
                3'-CUACAGAGGUCGUAAAAAUGCCUGG G_U-5'   (SEQ ID NO: 433)

MET-1364 Tar-   5'-GATGTCTCCAGCATTTTTACGGACCCA-3'     (SEQ ID NO: 793)
get:

5'-AUGUCUCCAGCAUUUUUACGGACCC C^C-3'   (SEQ ID NO: 1874)
                3'-UACAGAGGUCGUAAAAAUGCCUGGG U_U-5'   (SEQ ID NO: 434)

MET-1365 Tar-   5'-ATGTCTCCAGCATTTTTACGGACCCAA-3'     (SEQ ID NO: 794)
get:

5'-UGUCUCCAGCAUUUUUACGGACCCA C^C-3'   (SEQ ID NO: 1875)
                3'-ACAGAGGUCGUAAAAAUGCCUGGGU U_A-5'   (SEQ ID NO: 435)

MET-1366 Tar-   5'-TGTCTCCAGCATTTTTACGGACCCAAT-3'     (SEQ ID NO: 795)
get:

5'-GUCUCCAGCAUUUUUACGGACCCAA C^A-3'   (SEQ ID NO: 1876)
                3'-CAGAGGUCGUAAAAAUGCCUGGGUU A_G-5'   (SEQ ID NO: 436)

MET-1367 Tar-   5'-GTCTCCAGCATTTTTACGGACCCAATC-3'     (SEQ ID NO: 796)
get:

5'-UCUCCAGCAUUUUUACGGACCCAAU A^C-3'   (SEQ ID NO: 1877)
                3'-AGAGGUCGUAAAAAUGCCUGGGUUA G_U-5'   (SEQ ID NO: 437)

MET-1368 Tar-   5'-TCTCCAGCATTTTTACGGACCCAATCA-3'     (SEQ ID NO: 797)
get:

5'-CUCCAGCAUUUUUACGGACCCAAUC C^C-3'   (SEQ ID NO: 1878)
                3'-GAGGUCGUAAAAAUGCCUGGGUUAG U_A-5'   (SEQ ID NO: 438)

MET-1369 Tar-   5'-CTCCAGCATTTTTACGGACCCAATCAT-3'     (SEQ ID NO: 798)
get:

5'-UCCAGCAUUUUUACGGACCCAAUCA C^A-3'   (SEQ ID NO: 1879)
                3'-AGGUCGUAAAAAUGCCUGGGUUAGU A_C-5'   (SEQ ID NO: 439)

MET-1370 Tar-   5'-TCCAGCATTTTTACGGACCCAATCATG-3'     (SEQ ID NO: 799)
get:
```

TABLE 7-continued

Selected Human Anti-MET "Blunt/Fray" DsiRNAs

```
                5'-CCAGCAUUUUACGGACCCAAUCAU A C-3'  (SEQ ID NO: 1880)
                3'-GGUCGUAAAAAUGCCUGGGUUAGUA C U-5'  (SEQ ID NO: 440)
```

MET-1371 Tar-    5'-CCAGCATTTTACGGACCCAATCATGA-3'  (SEQ ID NO: 800)
get:

```
                5'-AGUUUACCACAGCUUUGCAGCGCGU C A-3'  (SEQ ID NO: 1881)
                3'-UCAAAUGGUGUCGAAACGUCGCGCA A C-5'  (SEQ ID NO: 441)
```

MET-1469 Tar-    5'-AGTTTACCACAGCTTTGCAGCGCGTTG-3'  (SEQ ID NO: 801)
get:

```
                5'-UUUACCACAGCUUUGCAGCGCGUUG C A-3'  (SEQ ID NO: 1882)
                3'-AAAUGGUGUCGAAACGUCGCGCAAC U G-5'  (SEQ ID NO: 442)
```

MET-1471 Tar-    5'-TTTACCACAGCTTTGCAGCGCGTTGAC-3'  (SEQ ID NO: 802)
get:

```
                5'-UACCACAGCUUUGCAGCGCGUUGAC C C-3'  (SEQ ID NO: 1883)
                3'-AUGGUGUCGAAACGUCGCGCAACUG A A-5'  (SEQ ID NO: 443)
```

MET-1473 Tar-    5'-TACCACAGCTTTGCAGCGCGTTGACTT-3'  (SEQ ID NO: 803)
get:

```
                5'-ACCACAGCUUUGCAGCGCGUUGACU C C-3'  (SEQ ID NO: 1884)
                3'-UGGUGUCGAAACGUCGCGCAACUGA A U-5'  (SEQ ID NO: 444)
```

MET-1474 Tar-    5'-ACCACAGCTTTGCAGCGCGTTGACTTA-3'  (SEQ ID NO: 804)
get:

```
                5'-CACAGCUUUGCAGCGCGUUGACUUA C C-3'  (SEQ ID NO: 1885)
                3'-GUGUCGAAACGUCGCGCAACUGAAU A A-5'  (SEQ ID NO: 445)
```

MET-1476 Tar-    5'-CACAGCTTTGCAGCGCGTTGACTTATT-3'  (SEQ ID NO: 805)
get:

```
                5'-CAGCUUUGCAGCGCGUUGACUUAUU A C-3'  (SEQ ID NO: 1886)
                3'-GUCGAAACGUCGCGCAACUGAAUAA G U-5'  (SEQ ID NO: 446)
```

MET-1478 Tar-    5'-CAGCTTTGCAGCGCGTTGACTTATTCA-3'  (SEQ ID NO: 806)
get:

```
                5'-AGCUUUGCAGCGCGUUGACUUAUUC C C-3'  (SEQ ID NO: 1887)
                3'-UCGAAACGUCGCGCAACUGAAUAAG U A-5'  (SEQ ID NO: 447)
```

MET-1479 Tar-    5'-AGCTTTGCAGCGCGTTGACTTATTCAT-3'  (SEQ ID NO: 807)
get:

```
                5'-GCUUUGCAGCGCGUUGACUUAUUCA C A-3'  (SEQ ID NO: 1888)
                3'-CGAAACGUCGCGCAACUGAAUAAGU A C-5'  (SEQ ID NO: 448)
```

MET-1480 Tar-    5'-GCTTTGCAGCGCGTTGACTTATTCATG-3'  (SEQ ID NO: 808)
get:

```
                5'-CUUUGCAGCGCGUUGACUUAUUCAU A A-3'  (SEQ ID NO: 1889)
                3'-GAAACGUCGCGCAACUGAAUAAGUA C C-5'  (SEQ ID NO: 449)
```

MET-1481 Tar-    5'-CTTTGCAGCGCGTTGACTTATTCATGG-3'  (SEQ ID NO: 809)
get:

```
                5'-GCUGACCAUAUGUGGCUGGGACUUU A A-3'  (SEQ ID NO: 1890)
                3'-CGACUGGUAUACACCGACCCUGAAA C C-5'  (SEQ ID NO: 450)
```

MET-1953 Tar-    5'-GCTGACCATATGTGGCTGGGACTTTGG-3'  (SEQ ID NO: 810)
get:

US 9,670,488 B2
TABLE 7-continued

Selected Human Anti-MET "Blunt/Fray" DsiRNAs

```
                5'-CUGACCAUAUGUGGCUGGGACUUUG A C -3'   (SEQ ID NO: 1891)
                3'-GACUGGUAUACACCGACCCUGAAAC C U -5'   (SEQ ID NO: 451)
```

MET-1954 Tar-  5'-CTGACCATATGTGGCTGGGACTTTGGA-3'   (SEQ ID NO: 811)
get:

```
                5'-UGACCAUAUGUGGCUGGGACUUUGG C C -3'   (SEQ ID NO: 1892)
                3'-ACUGGUAUACACCGACCCUGAAACC U A -5'   (SEQ ID NO: 452)
```

MET-1955 Tar-  5'-TGACCATATGTGGCTGGGACTTTGGAT-3'   (SEQ ID NO: 812)
get:

```
                5'-GACCAUAUGUGGCUGGGACUUUGGA C C -3'   (SEQ ID NO: 1893)
                3'-CUGGUAUACACCGACCCUGAAACCU A A -5'   (SEQ ID NO: 453)
```

MET-1956 Tar-  5'-GACCATATGTGGCTGGGACTTTGGATT-3'   (SEQ ID NO: 813)
get:

```
                5'-ACCAUAUGUGGCUGGGACUUUGGAU C C -3'   (SEQ ID NO: 1894)
                3'-UGGUAUACACCGACCCUGAAACCUA A A -5'   (SEQ ID NO: 454)
```

MET-1957 Tar-  5'-ACCATATGTGGCTGGGACTTTGGATTT-3'   (SEQ ID NO: 814)
get:

```
                5'-CCAUAUGUGGCUGGGACUUUGGAUU C A -3'   (SEQ ID NO: 1895)
                3'-GGUAUACACCGACCCUGAAACCUAA A G -5'   (SEQ ID NO: 455)
```

MET-1958 Tar-  5'-CCATATGTGGCTGGGACTTTGGATTTC-3'   (SEQ ID NO: 815)
get:

```
                5'-CAUAUGUGGCUGGGACUUUGGAUUU A A -3'   (SEQ ID NO: 1896)
                3'-GUAUACACCGACCCUGAAACCUAAA G C -5'   (SEQ ID NO: 456)
```

MET-1959 Tar-  5'-CATATGTGGCTGGGACTTTGGATTTCG-3'   (SEQ ID NO: 816)
get:

```
                5'-AUAUGUGGCUGGGACUUUGGAUUUC A A -3'   (SEQ ID NO: 1897)
                3'-UAUACACCGACCCUGAAACCUAAAG C C -5'   (SEQ ID NO: 457)
```

MET-1960 Tar-  5'-ATATGTGGCTGGGACTTTGGATTTCGG-3'   (SEQ ID NO: 817)
get:

```
                5'-UAUGUGGCUGGGACUUUGGAUUUCG A C -3'   (SEQ ID NO: 1898)
                3'-AUACACCGACCCUGAAACCUAAAGC C U -5'   (SEQ ID NO: 458)
```

MET-1961 Tar-  5'-TATGTGGCTGGGACTTTGGATTTCGGA-3'   (SEQ ID NO: 818)
get:

```
                5'-AUGUGGCUGGGACUUUGGAUUUCGG C A -3'   (SEQ ID NO: 1899)
                3'-UACACCGACCCUGAAACCUAAAGCC U C -5'   (SEQ ID NO: 459)
```

MET-1962 Tar-  5'-ATGTGGCTGGGACTTTGGATTTCGGAG-3'   (SEQ ID NO: 819)
get:

```
                5'-UUCGGAGGAAUAAUAAAUUUGAUUU C C -3'   (SEQ ID NO: 1900)
                3'-AAGCCUCCUUAUUAUUUAAACUAAA U U -5'   (SEQ ID NO: 460)
```

MET-1982 Tar-  5'-TTCGGAGGAATAATAAATTTGATTTAA-3'   (SEQ ID NO: 820)
get:

```
                5'-AGGAAUAAUAAAUUUGAUUUAAAGA C C -3'   (SEQ ID NO: 1901)
                3'-UCCUUAUUAUUUAAACUAAAUUUCU U U -5'   (SEQ ID NO: 461)
```

MET-1987 Tar-  5'-AGGAATAATAAATTTGATTTAAAGAAA-3'   (SEQ ID NO: 821)
get:

TABLE 7-continued

Selected Human Anti-MET "Blunt/Fray" DsiRNAs

```
                5'-GGAAUAAUAAAUUUGAUUUAAAGAA^CC-3'      (SEQ ID NO: 1902)
                3'-CCUUAUUAUUUAAACUAAAUUUCUU_UU-5'      (SEQ ID NO: 462)

MET-1988 Target: 5'-GGAATAATAAATTTGATTTAAAGAAAA-3'      (SEQ ID NO: 822)

5'-CAUUGAAAUGCACAGUUGGUCCUGC^AC-3'      (SEQ ID NO: 1903)
                3'-GUAACUUUACGUGUCAACCAGGACG_GU-5'      (SEQ ID NO: 463)

MET-2075 Target: 5'-CATTGAAATGCACAGTTGGTCCTGCCA-3'      (SEQ ID NO: 823)

5'-AUUGAAAUGCACAGUUGGUCCUGCC^CC-3'      (SEQ ID NO: 1904)
                3'-UAACUUUACGUGUCAACCAGGACGG_UA-5'      (SEQ ID NO: 464)

MET-2076 Target: 5'-ATTGAAATGCACAGTTGGTCCTGCCAT-3'      (SEQ ID NO: 824)

5'-UUCAAUAUGUCCAUAAUUAUUUCAA^CC-3'      (SEQ ID NO: 1905)
                3'-AAGUUAUACAGGUAUUAAUAAAGUU_UA-5'      (SEQ ID NO: 465)

MET-2113 Target: 5'-TTCAATATGTCCATAATTATTTCAAAT-3'      (SEQ ID NO: 825)

5'-GGUGGAAAAACAUGUACUUUAAAAA^AC-3'      (SEQ ID NO: 1906)
                3'-CCACCUUUUUGUACAUGAAAUUUUU_CA-5'      (SEQ ID NO: 466)

MET-2290 Target: 5'-GGTGGAAAAACATGTACTTTAAAAAGT-3'      (SEQ ID NO: 826)

5'-UGUACCACUCCUUCCCUGCAACAGC^CA-3'      (SEQ ID NO: 1907)
                3'-ACAUGGUGAGGAAGGGACGUUGUCG_AC-5'      (SEQ ID NO: 467)

MET-2668 Target: 5'-TGTACCACTCCTTCCCTGCAACAGCTG-3'      (SEQ ID NO: 827)

5'-UAAGCCUUUUGAAAAGCCAGUGAUG^CC-3'      (SEQ ID NO: 1908)
                3'-AUUCGGAAAACUUUUCGGUCACUAC_UA-5'      (SEQ ID NO: 468)

MET-2790 Target: 5'-TAAGCCTTTTGAAAAGCCAGTGATGAT-3'      (SEQ ID NO: 828)

5'-UGAUAUUGACCCUGAAGCAGUUAAA^AA-3'      (SEQ ID NO: 1909)
                3'-ACUAUAACUGGGACUUCGUCAAUUU_CC-5'      (SEQ ID NO: 469)

MET-2856 Target: 5'-TGATATTGACCCTGAAGCAGTTAAAGG-3'      (SEQ ID NO: 829)

5'-GAUAUUGACCCUGAAGCAGUUAAAG^AC-3'      (SEQ ID NO: 1910)
                3'-CUAUAACUGGGACUUCGUCAAUUUC_CA-5'      (SEQ ID NO: 470)

MET-2857 Target: 5'-GATATTGACCCTGAAGCAGTTAAAGGT-3'      (SEQ ID NO: 830)

5'-AUAUUGACCCUGAAGCAGUUAAAGG^CA-3'      (SEQ ID NO: 1911)
                3'-UAUAACUGGGACUUCGUCAAUUUCC_AC-5'      (SEQ ID NO: 471)

MET-2858 Target: 5'-ATATTGACCCTGAAGCAGTTAAAGGTG-3'      (SEQ ID NO: 831)

5'-UAUUGACCCUGAAGCAGUUAAAGGU^AC-3'      (SEQ ID NO: 1912)
                3'-AUAACUGGGACUUCGUCAAUUUCCA_CU-5'      (SEQ ID NO: 472)

MET-2859 Target: 5'-TATTGACCCTGAAGCAGTTAAAGGTGA-3'      (SEQ ID NO: 832)
```

TABLE 7-continued

Selected Human Anti-MET "Blunt/Fray" DsiRNAs

```
                  5'-AUUGACCCUGAAGCAGUUAAAGGUG C C-3'    (SEQ ID NO: 1913)
                  3'-UAACUGGGACUUCGUCAAUUUCCAC U U-5'    (SEQ ID NO: 473)

MET-2860 Tar-    5'-ATTGACCCTGAAGCAGTTAAAGGTGAA-3'     (SEQ ID NO: 833)
get:

5'-UUGACCCUGAAGCAGUUAAAGGUGA C A-3'    (SEQ ID NO: 1914)
                  3'-AACUGGGACUUCGUCAAUUUCCACU U C-5'    (SEQ ID NO: 474)

MET-2861 Tar-    5'-TTGACCCTGAAGCAGTTAAAGGTGAAG-3'     (SEQ ID NO: 834)
get:

5'-UGACCCUGAAGCAGUUAAAGGUGAA A C-3'    (SEQ ID NO: 1915)
                  3'-ACUGGGACUUCGUCAAUUUCCACUU C A-5'    (SEQ ID NO: 475)

MET-2862 Tar-    5'-TGACCCTGAAGCAGTTAAAGGTGAAGT-3'     (SEQ ID NO: 835)
get:

5'-GACCCUGAAGCAGUUAAAGGUGAAG C A-3     (SEQ ID NO: 1916)
                  3'-CUGGGACUUCGUCAAUUUCCACUUC A C-5     (SEQ ID NO: 476)

MET-2863 Tar-    5'-GACCCTGAAGCAGTTAAAGGTGAAGTG-3'     (SEQ ID NO: 836)
get:

5'-ACCCUGAAGCAGUUAAAGGUGAAGU A C-3'    (SEQ ID NO: 1917)
                  3'-UGGGACUUCGUCAAUUUCCACUUCA C A-5'    (SEQ ID NO: 477)

MET-2864 Tar-    5'-ACCCTGAAGCAGTTAAAGGTGAAGTGT-3'     (SEQ ID NO: 837)
get:

5'-CCCUGAAGCAGUUAAAGGUGAAGUG C C-3'    (SEQ ID NO: 1918)
                  3'-GGGACUUCGUCAAUUUCCACUUCAC A A-5'    (SEQ ID NO: 478)

MET-2865 Tar-    5'-CCCTGAAGCAGTTAAAGGTGAAGTGTT-3'     (SEQ ID NO: 838)
get:

5'-CCUGAAGCAGUUAAAGGUGAAGUGU C C-3'    (SEQ ID NO: 1919)
                  3'-GGACUUCGUCAAUUUCCACUUCACA A U-5'    (SEQ ID NO: 479)

MET-2866 Tar-    5'-CCTGAAGCAGTTAAAGGTGAAGTGTTA-3'     (SEQ ID NO: 839)
get:

5'-CUGAAGCAGUUAAAGGUGAAGUGUU C C-3'    (SEQ ID NO: 1920)
                  3'-GACUUCGUCAAUUUCCACUUCACAA U U-5'    (SEQ ID NO: 480)

MET-2867 Tar-    5'-CTGAAGCAGTTAAAGGTGAAGTGTTAA-3'     (SEQ ID NO: 840)
get:

5'-UGAAGCAGUUAAAGGUGAAGUGUUA C C-3'    (SEQ ID NO: 1921)
                  3'-ACUUCGUCAAUUUCCACUUCACAAU U U-5'    (SEQ ID NO: 481)

MET-2868 Tar-    5'-TGAAGCAGTTAAAGGTGAAGTGTTAAA-3'     (SEQ ID NO: 841)
get:

5'-GAAGCAGUUAAAGGUGAAGUGUUAA C C-3'    (SEQ ID NO: 1922)
                  3'-CUUCGUCAAUUUCCACUUCACAAUU U U-5'    (SEQ ID NO: 482)

MET-2869 Tar-    5'-GAAGCAGTTAAAGGTGAAGTGTTAAAA-3'     (SEQ ID NO: 842)
get:

5'-AAGCAGUUAAAGGUGAAGUGUUAAA C A-3'    (SEQ ID NO: 1923)
                  3'-UUCGUCAAUUUCCACUUCACAAUUU U C-5'    (SEQ ID NO: 483)

MET-2870 Tar-    5'-AAGCAGTTAAAGGTGAAGTGTTAAAAG-3'     (SEQ ID NO: 843)
get:
```

TABLE 7-continued

Selected Human Anti-MET "Blunt/Fray" DsiRNAs

```
                    5'-AGCAGUUAAAGGUGAAGUGUUAAAA A C-3'   (SEQ ID NO: 1924)
                    3'-UCGUCAAUUUCCACUUCACAAUUUU C A-5'   (SEQ ID NO: 484)

MET-2871 Tar-       5'-AGCAGTTAAAGGTGAAGTGTTAAAGT-3'      (SEQ ID NO: 844)
get:

5'-GCAGUUAAAGGUGAAGUGUUAAAG C C-3'    (SEQ ID NO: 1925)
                    3'-CGUCAAUUUCCACUUCACAAUUUC A A-5'    (SEQ ID NO: 485)

MET-2872 Tar-       5'-GCAGTTAAAGGTGAAGTGTTAAAGTT-3'      (SEQ ID NO: 845)
get:

5'-CAGUUAAAGGUGAAGUGUUAAAGU C A-3'    (SEQ ID NO: 1926)
                    3'-GUCAAUUUCCACUUCACAAUUUCA A C-5'    (SEQ ID NO: 486)

MET-2873 Tar-       5'-CAGTTAAAGGTGAAGTGTTAAAGTTG-3'      (SEQ ID NO: 846)
get:

5'-AGUUAAAGGUGAAGUGUUAAAAGUU A A-3'   (SEQ ID NO: 1927)
                    3'-UCAAUUUCCACUUCACAAUUUUCAA C C-5'   (SEQ ID NO: 487)

MET-2874 Tar-       5'-AGTTAAAGGTGAAGTGTTAAAGTTGG-3'      (SEQ ID NO: 847)
get:

5'-GUUAAAGGUGAAGUGUUAAAAGUUG A C-3'   (SEQ ID NO: 1928)
                    3'-CAAUUUCCACUUCACAAUUUUCAAC C U-5'   (SEQ ID NO: 488)

MET-2875 Tar-       5'-GTTAAAGGTGAAGTGTTAAAGTTGGA-3'      (SEQ ID NO: 848)
get:

5'-UUAAAGGUGAAGUGUUAAAAGUUGG C C-3'   (SEQ ID NO: 1929)
                    3'-AAUUUCCACUUCACAAUUUUCAACC U U-5'   (SEQ ID NO: 489)

MET-2876 Tar-       5'-TTAAAGGTGAAGTGTTAAAGTTGGAA-3'      (SEQ ID NO: 849)
get:

5'-UAAAGGUGAAGUGUUAAAAGUUGGA C C-3'   (SEQ ID NO: 1930)
                    3'-AUUUCCACUUCACAAUUUUCAACCU U U-5'   (SEQ ID NO: 490)

MET-2877 Tar-       5'-TAAAGGTGAAGTGTTAAAGTTGGAAA-3'      (SEQ ID NO: 850)
get:

5'-AAAGGUGAAGUGUUAAAAGUUGGAA C C-3'   (SEQ ID NO: 1931)
                    3'-UUUCCACUUCACAAUUUUCAACCUU U A-5'   (SEQ ID NO: 491)

MET-2878 Tar-       5'-AAAGGTGAAGTGTTAAAGTTGGAAAT-3'      (SEQ ID NO: 851)
get:

5'-AAGGUGAAGUGUUAAAAGUUGGAAA C C-3'   (SEQ ID NO: 1932)
                    3'-UUCCACUUCACAAUUUUCAACCUUU A U-5'   (SEQ ID NO: 492)

MET-2879 Tar-       5'-AAGGTGAAGTGTTAAAGTTGGAAATA-3'      (SEQ ID NO: 852)
get:

5'-AGGUGAAGUGUUAAAAGUUGGAAAU C C-3'   (SEQ ID NO: 1933)
                    3'-UCCACUUCACAAUUUUCAACCUUUA U U-5'   (SEQ ID NO: 493)

MET-2880 Tar-       5'-AGGTGAAGTGTTAAAGTTGGAAATAA-3'      (SEQ ID NO: 853)
get:

5'-GGUGAAGUGUUAAAAGUUGGAAAUA C A-3'   (SEQ ID NO: 1934)
                    3'-CCACUUCACAAUUUUCAACCUUUAU U C-5'   (SEQ ID NO: 494)

MET-2881 Tar-       5'-GGTGAAGTGTTAAAGTTGGAAATAAG-3'      (SEQ ID NO: 854)
get:
```

TABLE 7-continued

Selected Human Anti-MET "Blunt/Fray" DsiRNAs

```
                 5'-GUGAAGUGUUAAAAGUUGGAAAUAA A^C-3'    (SEQ ID NO: 1935)
                 3'-CACUUCACAAUUUUCAACCUUUAUU C_U-5'    (SEQ ID NO: 495)
```

MET-2882 Tar-    5'-GTGAAGTGTTAAAAGTTGGAAATAAGA-3'    (SEQ ID NO: 855)
get:

```
                 5'-UGAAGUGUUAAAAGUUGGAAAUAAG C^A-3'   (SEQ ID NO: 1936)
                 3'-ACUUCACAAUUUUCAACCUUUAUUC U_C-5'   (SEQ ID NO: 496)
```

MET-2883 Tar-    5'-TGAAGTGTTAAAAGTTGGAAATAAGAG-3'   (SEQ ID NO: 856)
get:

```
                 5'-GAAGUGUUAAAAGUUGGAAAUAAGA A^A-3'   (SEQ ID NO: 1937)
                 3'-CUUCACAAUUUUCAACCUUUAUUCU C_G-5'   (SEQ ID NO: 497)
```

MET-2884 Tar-    5'-GAAGTGTTAAAAGTTGGAAATAAGAGC-3'   (SEQ ID NO: 857)
get:

```
                 5'-AUUGAACAGCGAGCUAAAUAUAGAG C^A-3'   (SEQ ID NO: 1938)
                 3'-UAACUUGUCGCUCGAUUUAUAUCUC A_C-5'   (SEQ ID NO: 498)
```

MET-2973 Tar-    5'-ATTGAACAGCGAGCTAAATATAGAGTG-3'   (SEQ ID NO: 858)
get:

```
                 5'-UUGAACAGCGAGCUAAAUAUAGAGU A^A-3'   (SEQ ID NO: 1939)
                 3'-AACUUGUCGCUCGAUUUAUAUCUCA C_C-5'   (SEQ ID NO: 499)
```

MET-2974 Tar-    5'-TTGAACAGCGAGCTAAATATAGAGTGG-3'   (SEQ ID NO: 859)
get:

```
                 5'-UGAACAGCGAGCUAAAUAUAGAGUG A^C-3'   (SEQ ID NO: 1940)
                 3'-ACUUGUCGCUCGAUUUAUAUCUCAC C_U-5'   (SEQ ID NO: 500)
```

MET-2975 Tar-    5'-TGAACAGCGAGCTAAATATAGAGTGGA-3'   (SEQ ID NO: 860)
get:

```
                 5'-GAACAGCGAGCUAAAUAUAGAGUGG C^C-3'   (SEQ ID NO: 1941)
                 3'-CUUGUCGCUCGAUUUAUAUCUCACC U_U-5'   (SEQ ID NO: 501)
```

MET-2976 Tar-    5'-GAACAGCGAGCTAAATATAGAGTGGAA-3'   (SEQ ID NO: 861)
get:

```
                 5'-AACAGCGAGCUAAAUAUAGAGUGGA C^A-3'   (SEQ ID NO: 1942)
                 3'-UUGUCGCUCGAUUUAUAUCUCACCU U_C-5'   (SEQ ID NO: 502)
```

MET-2977 Tar-    5'-AACAGCGAGCTAAATATAGAGTGGAAG-3'   (SEQ ID NO: 862)
get:

```
                 5'-ACAGCGAGCUAAAUAUAGAGUGGAA A^A-3'   (SEQ ID NO: 1943)
                 3'-UGUCGCUCGAUUUAUAUCUCACCUU C_G-5'   (SEQ ID NO: 503)
```

MET-2978 Tar-    5'-ACAGCGAGCTAAATATAGAGTGGAAGC-3'   (SEQ ID NO: 863)
get:

```
                 5'-CAGCGAGCUAAAUAUAGAGUGGAAG A^C-3'   (SEQ ID NO: 1944)
                 3'-GUCGCUCGAUUUAUAUCUCACCUUC G_U-5'   (SEQ ID NO: 504)
```

MET-2979 Tar-    5'-CAGCGAGCTAAATATAGAGTGGAAGCA-3'   (SEQ ID NO: 864)
get:

```
                 5'-AGCGAGCUAAAUAUAGAGUGGAAGC C^C-3'   (SEQ ID NO: 1945)
                 3'-UCGCUCGAUUUAUAUCUCACCUUCG U_U-5'   (SEQ ID NO: 505)
```

MET-2980 Tar-    5'-AGCGAGCTAAATATAGAGTGGAAGCAA-3'   (SEQ ID NO: 865)
get:

TABLE 7-continued

Selected Human Anti-MET "Blunt/Fray" DsiRNAs

```
              5'-GCGAGCUAAAUAUAGAGUGGAAGCA C^A-3'   (SEQ ID NO: 1946)
              3'-CGCUCGAUUUAUAUCUCACCUUCGU U_C-5'   (SEQ ID NO: 506)

MET-2981 Tar-  5'-GCGAGCTAAATATAGAGTGGAAGCAAG-3'   (SEQ ID NO: 866)
get:

5'-CGAGCUAAAUAUAGAGUGGAAGCAA A^A-3'   (SEQ ID NO: 1947)
              3'-GCUCGAUUUAUAUCUCACCUUCGUU C_G-5'   (SEQ ID NO: 507)

MET-2982 Tar-  5'-CGAGCTAAATATAGAGTGGAAGCAAGC-3'   (SEQ ID NO: 867)
get:

5'-GAGCUAAAUAUAGAGUGGAAGCAAG A^C-3'   (SEQ ID NO: 1948)
              3'-CUCGAUUUAUAUCUCACCUUCGUUC G_U-5'   (SEQ ID NO: 508)

MET-2983 Tar-  5'-GAGCTAAATATAGAGTGGAAGCAAGCA-3'   (SEQ ID NO: 868)
get:

5'-AGCUAAAUAUAGAGUGGAAGCAAGC C^C-3'   (SEQ ID NO: 1949)
              3'-UCGAUUUAUAUCUCACCUUCGUUCG U_U-5'   (SEQ ID NO: 509)

MET-2984 Tar-  5'-AGCTAAATATAGAGTGGAAGCAAGCAA-3'   (SEQ ID NO: 869)
get:

5'-GCUAAAUAUAGAGUGGAAGCAAGCA C^C-3'   (SEQ ID NO: 1950)
              3'-CGAUUUAUAUCUCACCUUCGUUCGU U_A-5'   (SEQ ID NO: 510)

MET-2985 Tar-  5'-GCTAAATATAGAGTGGAAGCAAGCAAT-3'   (SEQ ID NO: 870)
get:

5'-CUAAAUAUAGAGUGGAAGCAAGCAA C^C-3'   (SEQ ID NO: 1951)
              3'-GAUUUAUAUCUCACCUUCGUUCGUU A_A-5'   (SEQ ID NO: 511)

MET-2986 Tar-  5'-CTAAATATAGAGTGGAAGCAAGCAATT-3'   (SEQ ID NO: 871)
get:

5'-UAAAUAUAGAGUGGAAGCAAGCAAU C^C-3'   (SEQ ID NO: 1952)
              3'-AUUUAUAUCUCACCUUCGUUCGUUA A_A-5'   (SEQ ID NO: 512)

MET-2987 Tar-  5'-TAAATATAGAGTGGAAGCAAGCAATTT-3'   (SEQ ID NO: 872)
get:

5'-AAAUAUAGAGUGGAAGCAAGCAAUU C^A-3'   (SEQ ID NO: 1953)
              3'-UUUAUAUCUCACCUUCGUUCGUUAA A_G-5'   (SEQ ID NO: 513)

MET-2988 Tar-  5'-AAATATAGAGTGGAAGCAAGCAATTTC-3'   (SEQ ID NO: 873)
get:

5'-AAUAUAGAGUGGAAGCAAGCAAUUU A^C-3'   (SEQ ID NO: 1954)
              3'-UUAUAUCUCACCUUCGUUCGUUAAA G_A-5'   (SEQ ID NO: 514)

MET-2989 Tar-  5'-AATATAGAGTGGAAGCAAGCAATTTCT-3'   (SEQ ID NO: 874)
get:

5'-CUUGGGUUUUUCCUGUGGCUGAAAA C^A-3'   (SEQ ID NO: 1955)
              3'-GAACCCAAAAAGGACACCGACUUUUU U_C-5'   (SEQ ID NO: 515)

MET-3112 Tar-  5'-CTTGGGTTTTCCTGTGGCTGAAAAG-3'   (SEQ ID NO: 875)
get:

5'-GUGGCUGAAAAAGAGAAAGCAAAUU C^C-3'   (SEQ ID NO: 1956)
              3'-CACCGACUUUUUCUCUUUCGUUUAA U_U-5'   (SEQ ID NO: 516)

MET-3126 Tar-  5'-GTGGCTGAAAAAGAGAAAGCAAATTAA-3'   (SEQ ID NO: 876)
get:
```

TABLE 7-continued

Selected Human Anti-MET "Blunt/Fray" DsiRNAs

```
                5'-AUUAAAGAUCUGGGCAGUGAAUUAGC^C-3'      (SEQ ID NO: 1957)
                3'-UAAUUUCUAGACCCGUCACUUAAUC_A^A-5'     (SEQ ID NO: 517)

MET-3148 Tar-   5'-ATTAAAGATCTGGGCAGTGAATTAGTT-3'       (SEQ ID NO: 877)
get:

5'-UUAAAGAUCUGGGCAGUGAAUUAGU^CA-3'      (SEQ ID NO: 1958)
                3'-AAUUUCUAGACCCGUCACUUAAUCA_A^G-5'     (SEQ ID NO: 518)

MET-3149 Tar-   5'-TTAAAGATCTGGGCAGTGAATTAGTTC-3'       (SEQ ID NO: 878)
get:

5'-UAAAGAUCUGGGCAGUGAAUUAGUU^AA-3'      (SEQ ID NO: 1959)
                3'-AUUUCUAGACCCGUCACUUAAUCAA_G^C-5'     (SEQ ID NO: 519)

MET-3150 Tar-   5'-TAAAGATCTGGGCAGTGAATTAGTTCG-3'       (SEQ ID NO: 879)
get:

5'-AAAGAUCUGGGCAGUGAAUUAGUUC^AA-3'      (SEQ ID NO: 1960)
                3'-UUUCUAGACCCGUCACUUAAUCAAG_G^C-5'     (SEQ ID NO: 520)

MET-3151 Tar-   5'-AAAGATCTGGGCAGTGAATTAGTTCGC-3'       (SEQ ID NO: 880)
get:

5'-AAGAUCUGGGCAGUGAAUUAGUUCG^AC-3'      (SEQ ID NO: 1961)
                3'-UUCUAGACCCGUCACUUAAUCAAGC_A^G-5'     (SEQ ID NO: 521)

MET-3152 Tar-   5'-AAGATCTGGGCAGTGAATTAGTTCGCT-3'       (SEQ ID NO: 881)
get:

5'-AGAUCUGGGCAGUGAAUUAGUUCGC^CC-3'      (SEQ ID NO: 1962)
                3'-UCUAGACCCGUCACUUAAUCAAGCG_U^A-5'     (SEQ ID NO: 522)

MET-3153 Tar-   5'-AGATCTGGGCAGTGAATTAGTTCGCTA-3'       (SEQ ID NO: 882)
get:

5'-GAUCUGGGCAGUGAAUUAGUUCGCU^CA-3'      (SEQ ID NO: 1963)
                3'-CUAGACCCGUCACUUAAUCAAGCGA_G^U-5'     (SEQ ID NO: 253)

MET-3154 Tar-   5'-GATCTGGGCAGTGAATTAGTTCGCTAC-3'       (SEQ ID NO: 883)
get:

5'-AUCUGGGCAGUGAAUUAGUUCGCUA^AA-3'      (SEQ ID NO: 1964)
                3'-UAGACCCGUCACUUAAUCAAGCGAU_C^G-5'     (SEQ ID NO: 524)

MET-3155 Tar-   5'-ATCTGGGCAGTGAATTAGTTCGCTACG-3'       (SEQ ID NO: 884)
get:

5'-UCUGGGCAGUGAAUUAGUUCGCUAC^CA-3'      (SEQ ID NO: 1965)
                3'-AGACCCGUCACUUAAUCAAGCGAUG_U^C-5'     (SEQ ID NO: 525)

MET-3156 Tar-   5'-TCTGGGCAGTGAATTAGTTCGCTACGA-3'       (SEQ ID NO: 885)
get:

5'-CUGGGCAGUGAAUUAGUUCGCUACG^CC-3'      (SEQ ID NO: 1966)
                3'-GACCCGUCACUUAAUCAAGCGAUGC_A^U-5'     (SEQ ID NO: 526)

MET-3157 Tar-   5'-CTGGGCAGTGAATTAGTTCGCTACGAT-3'       (SEQ ID NO: 886)
get:

5'-UGGGCAGUGAAUUAGUUCGCUACGA^CA-3'      (SEQ ID NO: 1967)
                3'-ACCCGUCACUUAAUCAAGCGAUGCU_C^A-5'     (SEQ ID NO: 527)

MET-3158 Tar-   5'-TGGGCAGTGAATTAGTTCGCTACGATG-3'       (SEQ ID NO: 887)
get:
```

TABLE 7-continued

Selected Human Anti-MET "Blunt/Fray" DsiRNAs

```
                 5'-GGGCAGUGAAUUAGUUCGCUACGAU A -3'   (SEQ ID NO: 1968)
                                              A
                 3'-CCCGUCACUUAAUCAAGCGAUGCUA C -5'   (SEQ ID NO: 528)
                                              G
```

MET-3159 Tar-  5'-GGGCAGTGAATTAGTTCGCTACGATGC-3'  (SEQ ID NO: 888)
get:

```
                 5'-CACACUCCUCAUUUGGAUAGGCUUG C -3'   (SEQ ID NO: 1969)
                                             C
                 3'-GUGUGAGGAGUAAACCUAUCCGAAC A -5'   (SEQ ID NO: 529)
                                             U
```

MET-3193 Tar-  5'-CACACTCCTCATTTGGATAGGCTTGTA-3'  (SEQ ID NO: 889)
get:

```
                 5'-ACACUCCUCAUUUGGAUAGGCUUGU C -3'   (SEQ ID NO: 1970)
                                              C
                 3'-UGUGAGGAGUAAACCUAUCCGAACA U -5'   (SEQ ID NO: 530)
                                              U
```

MET-3194 Tar-  5'-ACACTCCTCATTTGGATAGGCTTGTAA-3'  (SEQ ID NO: 890)
get:

```
                 5'-CACUCCUCAUUUGGAUAGGCUUGUA C -3'   (SEQ ID NO: 1971)
                                              A
                 3'-GUGAGGAGUAAACCUAUCCGAACAU U -5'   (SEQ ID NO: 531)
                                              C
```

MET-3195 Tar-  5'-CACTCCTCATTTGGATAGGCTTGTAAG-3'  (SEQ ID NO: 891)
get:

```
                 5'-ACUCCUCAUUUGGAUAGGCUUGUAA A -3'   (SEQ ID NO: 1972)
                                              C
                 3'-UGAGGAGUAAACCUAUCCGAACAUU C -5'   (SEQ ID NO: 532)
                                              A
```

MET-3196 Tar-  5'-ACTCCTCATTTGGATAGGCTTGTAAGT-3'  (SEQ ID NO: 892)
get:

```
                 5'-CUCCUCAUUUGGAUAGGCUUGUAAG C -3'   (SEQ ID NO: 1973)
                                              A
                 3'-GAGGAGUAAACCUAUCCGAACAUUC A -5'   (SEQ ID NO: 533)
                                              C
```

MET-3197 Tar-  5'-CTCCTCATTTGGATAGGCTTGTAAGTG-3'  (SEQ ID NO: 893)
get:

```
                 5'-UCCUCAUUUGGAUAGGCUUGUAAGU A -3'   (SEQ ID NO: 1974)
                                              A
                 3'-AGGAGUAAACCUAUCCGAACAUUCA C -5'   (SEQ ID NO: 534)
                                              G
```

MET-3198 Tar-  5'-TCCTCATTTGGATAGGCTTGTAAGTGC-3'  (SEQ ID NO: 894)
get:

```
                 5'-CCUCAUUUGGAUAGGCUUGUAAGUG A -3'   (SEQ ID NO: 1975)
                                              A
                 3'-GGAGUAAACCUAUCCGAACAUUCAC G -5'   (SEQ ID NO: 535)
                                              G
```

MET-3199 Tar-  5'-CCTCATTTGGATAGGCTTGTAAGTGCC-3'  (SEQ ID NO: 895)
get:

```
                 5'-CUCAUUUGGAUAGGCUUGUAAGUGC A -3'   (SEQ ID NO: 1976)
                                              A
                 3'-GAGUAAACCUAUCCGAACAUUCACG G -5'   (SEQ ID NO: 536)
                                              G
```

MET-3200 Tar-  5'-CTCATTTGGATAGGCTTGTAAGTGCCC-3'  (SEQ ID NO: 896)
get:

```
                 5'-UCAUUUGGAUAGGCUUGUAAGUGCC A -3'   (SEQ ID NO: 1977)
                                              A
                 3'-AGUAAACCUAUCCGAACAUUCACGG G -5'   (SEQ ID NO: 537)
                                              C
```

MET-3201 Tar-  5'-TCATTTGGATAGGCTTGTAAGTGCCCG-3'  (SEQ ID NO: 897)
get:

```
                 5'-CAUUUGGAUAGGCUUGUAAGUGCCC A -3'   (SEQ ID NO: 1978)
                                              C
                 3'-GUAAACCUAUCCGAACAUUCACGGG C -5'   (SEQ ID NO: 538)
                                              U
```

MET-3202 Tar-  5'-CATTTGGATAGGCTTGTAAGTGCCCGA-3'  (SEQ ID NO: 898)
get:

TABLE 7-continued

Selected Human Anti-MET "Blunt/Fray" DsiRNAs

```
                    5'-AUUUGGAUAGGCUUGUAAGUGCCCG C C-3'  (SEQ ID NO: 1979)
                    3'-UAAACCUAUCCGAACAUUCACGGGC U U-5'  (SEQ ID NO: 539)

MET-3203 Tar-       5'-ATTTGGATAGGCTTGTAAGTGCCCGAA-3'    (SEQ ID NO: 899)
get:

5'-UUUGGAUAGGCUUGUAAGUGCCCGA C A-3'  (SEQ ID NO: 1980)
                    3'-AAACCUAUCCGAACAUUCACGGGCU U C-5'  (SEQ ID NO: 540)

MET-3204 Tar-       5'-TTTGGATAGGCTTGTAAGTGCCCGAAG-3'   (SEQ ID NO: 900)
get:

5'-UUGGAUAGGCUUGUAAGUGCCCGAA A C-3'  (SEQ ID NO: 1981)
                    3'-AACCUAUCCGAACAUUCACGGGCUU C A-5'  (SEQ ID NO: 541)

MET-3205 Tar-       5'-TTGGATAGGCTTGTAAGTGCCCGAAGT-3'   (SEQ ID NO: 901)
get:

5'-UGGAUAGGCUUGUAAGUGCCCGAAG C A-3'  (SEQ ID NO: 1982)
                    3'-ACCUAUCCGAACAUUCACGGGCUUC A C-5'  (SEQ ID NO: 542)

MET-3206 Tar-       5'-TGGATAGGCTTGTAAGTGCCCGAAGTG-3'   (SEQ ID NO: 902)
get:

5'-GGAUAGGCUUGUAAGUGCCCGAAGU A C-3'  (SEQ ID NO: 1983)
                    3'-CCUAUCCGAACAUUCACGGGCUUCA C A-5'  (SEQ ID NO: 543)

MET-3207 Tar-       5'-GGATAGGCTTGTAAGTGCCCGAAGTGT-3'   (SEQ ID NO: 903)
get:

5'-GAUAGGCUUGUAAGUGCCCGAAGUG C C-3'  (SEQ ID NO: 1984)
                    3'-CUAUCCGAACAUUCACGGGCUUCAC A U-5'  (SEQ ID NO: 544)

MET-3208 Tar-       5'-GATAGGCTTGTAAGTGCCCGAAGTGTA-3'   (SEQ ID NO: 904)
get:

5'-AUAGGCUUGUAAGUGCCCGAAGUGU C C-3'  (SEQ ID NO: 1985)
                    3'-UAUCCGAACAUUCACGGGCUUCACA U U-5'  (SEQ ID NO: 545)

MET-3209 Tar-       5'-ATAGGCTTGTAAGTGCCCGAAGTGTAA-3'   (SEQ ID NO: 905)
get:

5'-UAGGCUUGUAAGUGCCCGAAGUGUA C A-3'  (SEQ ID NO: 1986)
                    3'-AUCCGAACAUUCACGGGCUUCACAU U C-5'  (SEQ ID NO: 546)

MET-3210 Tar-       5'-TAGGCTTGTAAGTGCCCGAAGTGTAAG-3'   (SEQ ID NO: 906)
get:

5'-AGGCUUGUAAGUGCCCGAAGUGUAA A A-3'  (SEQ ID NO: 1987)
                    3'-UCCGAACAUUCACGGGCUUCACAUU C G-5'  (SEQ ID NO: 547)

MET-3211 Tar-       5'-AGGCTTGTAAGTGCCCGAAGTGTAAGC-3'   (SEQ ID NO: 907)
get:

5'-GGCUUGUAAGUGCCCGAAGUGUAAG A A-3'  (SEQ ID NO: 1988)
                    3'-CCGAACAUUCACGGGCUUCACAUUC G G-5'  (SEQ ID NO: 548)

MET-3212 Tar-       5'-GGCTTGTAAGTGCCCGAAGTGTAAGCC-3'   (SEQ ID NO: 908)
get:

5'-GCUUGUAAGUGCCCGAAGUGUAAGC A A-3'  (SEQ ID NO: 1989)
                    3'-CGAACAUUCACGGGCUUCACAUUCG G G-5'  (SEQ ID NO: 549)

MET-3213 Tar-       5'-GCTTGTAAGTGCCCGAAGTGTAAGCCC-3'   (SEQ ID NO: 909)
get:
```

TABLE 7-continued

Selected Human Anti-MET "Blunt/Fray" DsiRNAs

```
                5'-CUUGUAAGUGCCCGAAGUGUAAGCC A C-3'    (SEQ ID NO: 1990)
                3'-GAACAUUCACGGGCUUCACAUUCGG G U-5'    (SEQ ID NO: 550)

MET-3214 Tar-   5'-CTTGTAAGTGCCCGAAGTGTAAGCCCA-3'    (SEQ ID NO: 910)
get:

5'-UUGUAAGUGCCCGAAGUGUAAGCCC C C-3'    (SEQ ID NO: 1991)
                3'-AACAUUCACGGGCUUCACAUUCGGG U U-5'    (SEQ ID NO: 551)

MET-3215 Tar-   5'-TTGTAAGTGCCCGAAGTGTAAGCCCAA-3'   (SEQ ID NO: 911)
get:

5'-UGUAAGUGCCCGAAGUGUAAGCCCA C A-3'    (SEQ ID NO: 1992)
                3'-ACAUUCACGGGCUUCACAUUCGGGU U G-5'    (SEQ ID NO: 552)

MET-3216 Tar-   5'-TGTAAGTGCCCGAAGTGTAAGCCCAAC-3'   (SEQ ID NO: 912)
get:

5'-CCGAGCUACUUUUCCAGAAGAUCAG C C-3'    (SEQ ID NO: 1993)
                3'-GGCUCGAUGAAAAGGUCUUCUAGUC A A-5'    (SEQ ID NO: 553)

MET-3276 Tar-   5'-CCGAGCTACTTTTCCAGAAGATCAGTT-3'   (SEQ ID NO: 913)
get:

5'-UCCACAUUGACCUCAGUGCUCUAAA C A-3'    (SEQ ID NO: 1994)
                3'-AGGUGUAACUGGAGUCACGAGAUUU A G-5'    (SEQ ID NO: 554)

MET-3419 Tar-   5'-TCCACATTGACCTCAGTGCTCTAAATC-3'   (SEQ ID NO: 914)
get:

5'-CCACAUUGACCUCAGUGCUCUAAAU A A-3'    (SEQ ID NO: 1995)
                3'-GGUGUAACUGGAGUCACGAGAUUUA G G-5'    (SEQ ID NO: 555)

MET-3420 Tar-   5'-CCACATTGACCTCAGTGCTCTAAATCC-3'   (SEQ ID NO: 915)
get:

5'-CACAUUGACCUCAGUGCUCUAAAUC A C-3'    (SEQ ID NO: 1996)
                3'-GUGUAACUGGAGUCACGAGAUUUAG G U-5'    (SEQ ID NO: 556)

MET-3421 Tar-   5'-CACATTGACCTCAGTGCTCTAAATCCA-3'   (SEQ ID NO: 916)
get:

5'-ACAUUGACCUCAGUGCUCUAAAUCC C A-3'    (SEQ ID NO: 1997)
                3'-UGUAACUGGAGUCACGAGAUUUAGG U C-5'    (SEQ ID NO: 557)

MET-3422 Tar-   5'-ACATTGACCTCAGTGCTCTAAATCCAG-3'   (SEQ ID NO: 917)
get:

5'-CAUUGACCUCAGUGCUCUAAAUCCA A C-3'    (SEQ ID NO: 1998)
                3'-GUAACUGGAGUCACGAGAUUUAGGU C U-5'    (SEQ ID NO: 558)

MET-3423 Tar-   5'-CATTGACCTCAGTGCTCTAAATCCAGA-3'   (SEQ ID NO: 918)
get:

5'-AUUGACCUCAGUGCUCUAAAUCCAG C A-3'    (SEQ ID NO: 1999)
                3'-UAACUGGAGUCACGAGAUUUAGGUC U C-5'    (SEQ ID NO: 559)

MET-3424 Tar-   5'-ATTGACCTCAGTGCTCTAAATCCAGAG-3'   (SEQ ID NO: 919)
get:

5'-UUGACCUCAGUGCUCUAAAUCCAGA A A-3'    (SEQ ID NO: 2000)
                3'-AACUGGAGUCACGAGAUUUAGGUCU C G-5'    (SEQ ID NO: 560)

MET-3425 Tar-   5'-TTGACCTCAGTGCTCTAAATCCAGAGC-3'   (SEQ ID NO: 920)
get:
```

TABLE 7-continued

Selected Human Anti-MET "Blunt/Fray" DsiRNAs

```
                  5'-UGACCUCAGUGCUCUAAAUCCAGAG A^C -3'  (SEQ ID NO: 2001)
                  3'-ACUGGAGUCACGAGAUUUAGGUCUC G_A -5'  (SEQ ID NO: 561)

MET-3426 Tar-     5'-TGACCTCAGTGCTCTAAATCCAGAGCT-3'    (SEQ ID NO: 921)
get:

5'-GACCUCAGUGCUCUAAAUCCAGAGC C^A -3'  (SEQ ID NO: 2002)
                  3'-CUGGAGUCACGAGAUUUAGGUCUCG _A_C -5' (SEQ ID NO: 562)

MET-3427 Tar-     5'-GACCTCAGTGCTCTAAATCCAGAGCTG-3'    (SEQ ID NO: 922)
get:

5'-ACCUCAGUGCUCUAAAUCCAGAGCU A^A -3'  (SEQ ID NO: 2003)
                  3'-UGGAGUCACGAGAUUUAGGUCUCGA _C_C -5' (SEQ ID NO: 563)

MET-3428 Tar-     5'-ACCTCAGTGCTCTAAATCCAGAGCTGG-3'    (SEQ ID NO: 923)
get:

5'-CCUCAGUGCUCUAAAUCCAGAGCUG A^C -3'  (SEQ ID NO: 2004)
                  3'-GGAGUCACGAGAUUUAGGUCUCGAC _C_A -5' (SEQ ID NO: 564)

MET-3429 Tar-     5'-CCTCAGTGCTCTAAATCCAGAGCTGGT-3'    (SEQ ID NO: 924)
get:

5'-CUCAGUGCUCUAAAUCCAGAGCUGG C^A -3'  (SEQ ID NO: 2005)
                  3'-GAGUCACGAGAUUUAGGUCUCGACC _A_G -5' (SEQ ID NO: 565)

MET-3430 Tar-     5'-CTCAGTGCTCTAAATCCAGAGCTGGTC-3'    (SEQ ID NO: 925)
get:

5'-UCAGUGCUCUAAAUCCAGAGCUGGU A^A -3'  (SEQ ID NO: 2006)
                  3'-AGUCACGAGAUUUAGGUCUCGACCA _G_G -5' (SEQ ID NO: 566)

MET-3431 Tar-     5'-TCAGTGCTCTAAATCCAGAGCTGGTCC-3'    (SEQ ID NO: 926)
get:

5'-CAGUGCUCUAAAUCCAGAGCUGGUC A^C -3'  (SEQ ID NO: 2007)
                  3'-GUCACGAGAUUUAGGUCUCGACCAG _G_U -5' (SEQ ID NO: 567)

MET-3432 Tar-     5'-CAGTGCTCTAAATCCAGAGCTGGTCCA-3'    (SEQ ID NO: 927)
get:

5'-AGUGCUCUAAAUCCAGAGCUGGUCC C^A -3'  (SEQ ID NO: 2008)
                  3'-UCACGAGAUUUAGGUCUCGACCAGG _U_C -5' (SEQ ID NO: 568)

MET-3433 Tar-     5'-AGTGCTCTAAATCCAGAGCTGGTCCAG-3'    (SEQ ID NO: 928)
get:

5'-GUGCUCUAAAUCCAGAGCUGGUCCA A^A -3'  (SEQ ID NO: 2009)
                  3'-CACGAGAUUUAGGUCUCGACCAGGU _C_C -5' (SEQ ID NO: 569)

MET-3434 Tar-     5'-GTGCTCTAAATCCAGAGCTGGTCCAGG-3'    (SEQ ID NO: 929)
get:

5'-UGCUCUAAAUCCAGAGCUGGUCCAG A^A -3'  (SEQ ID NO: 2010)
                  3'-ACGAGAUUUAGGUCUCGACCAGGUC _C_G -5' (SEQ ID NO: 570)

MET-3435 Tar-     5'-TGCTCTAAATCCAGAGCTGGTCCAGC-3'     (SEQ ID NO: 930)
get:

5'-GCUCUAAAUCCAGAGCUGGUCCAGG A^C -3'  (SEQ ID NO: 2011)
                  3'-CGAGAUUUAGGUCUCGACCAGGUCC _G_U -5' (SEQ ID NO: 571)

MET-3436 Tar-     5'-GCTCTAAATCCAGAGCTGGTCCAGCA-3'     (SEQ ID NO: 931)
get:
```

TABLE 7-continued

Selected Human Anti-MET "Blunt/Fray" DsiRNAs

```
                5'-CUCUAAAUCCAGAGCUGGUCCAGGC C A-3'    (SEQ ID NO: 2012)
                3'-GAGAUUUAGGUCUCGACCAGGUCCG U C-5'    (SEQ ID NO: 572)

MET-3437 Tar-   5'-CTCTAAATCCAGAGCTGGTCCAGGCAG-3'     (SEQ ID NO: 932)
get:

5'-UCUAAAUCCAGAGCUGGUCCAGGCA A C-3'    (SEQ ID NO: 2013)
                3'-AGAUUUAGGUCUCGACCAGGUCCGU C A-5'    (SEQ ID NO: 573)

MET-3438 Tar-   5'-TCTAAATCCAGAGCTGGTCCAGGCAGT-3'     (SEQ ID NO: 933)
get:

5'-GUAGCCUGAUUGUGCAUUUCAAUGA C A-3'    (SEQ ID NO: 2014)
                3'-CAUCGGACUAACACGUAAAGUUACU U C-5'    (SEQ ID NO: 574)

MET-3488 Tar-   5'-GTAGCCTGATTGTGCATTTCAATGAAG-3'     (SEQ ID NO: 934)
get:

5'-UAGCCUGAUUGUGCAUUUCAAUGAA A C-3'    (SEQ ID NO: 2015)
                3'-AUCGGACUAACACGUAAAGUUACUU C A-5'    (SEQ ID NO: 575)

MET-3489 Tar-   5'-TAGCCTGATTGTGCATTTCAATGAAGT-3'     (SEQ ID NO: 935)
get:

5'-AGCCUGAUUGUGCAUUUCAAUGAAG C A-3'    (SEQ ID NO: 2016)
                3'-UCGGACUAACACGUAAAGUUACUUC A G-5'    (SEQ ID NO: 576)

MET-3490 Tar-   5'-AGCCTGATTGTGCATTTCAATGAAGC-3'      (SEQ ID NO: 936)
get:

5'-GCCUGAUUGUGCAUUUCAAUGAAGU A C-3'    (SEQ ID NO: 2017)
                3'-CGGACUAACACGUAAAGUUACUUCA G U-5'    (SEQ ID NO: 577)

MET-3491 Tar-   5'-GCCTGATTGTGCATTTCAATGAAGTCA-3'     (SEQ ID NO: 937)
get:

5'-CCUGAUUGUGCAUUUCAAUGAAGUC C C-3'    (SEQ ID NO: 2018)
                3'-GGACUAACACGUAAAGUUACUUCAG U A-5'    (SEQ ID NO: 578)

MET-3492 Tar-   5'-CCTGATTGTGCATTTCAATGAAGTCAT-3'     (SEQ ID NO: 938)
get:

5'-CUGAUUGUGCAUUUCAAUGAAGUCA C C-3'    (SEQ ID NO: 2019)
                3'-GACUAACACGUAAAGUUACUUCAGU A U-5'    (SEQ ID NO: 579)

MET-3493 Tar-   5'-CTGATTGTGCATTTCAATGAAGTCATA-3'     (SEQ ID NO: 939)
get:

5'-UGAUUGUGCAUUUCAAUGAAGUCAU C A-3'    (SEQ ID NO: 2020)
                3'-ACUAACACGUAAAGUUACUUCAGUA U C-5'    (SEQ ID NO: 580)

MET-3494 Tar-   5'-TGATTGTGCATTTCAATGAAGTCATAG-3'     (SEQ ID NO: 940)
get:

5'-GAUUGUGCAUUUCAAUGAAGUCAUA A A-3'    (SEQ ID NO: 2021)
                3'-CUAACACGUAAAGUUACUUCAGUAU C C-5'    (SEQ ID NO: 581)

MET-3495 Tar-   5'-GATTGTGCATTTCAATGAAGTCATAGG-3'     (SEQ ID NO: 941)
get:

5'-AUUGUGCAUUUCAAUGAAGUCAUAG A C-3'    (SEQ ID NO: 2022)
                3'-UAACACGUAAAGUUACUUCAGUAUC C U-5'    (SEQ ID NO: 582)

MET-3496 Tar-   5'-ATTGTGCATTTCAATGAAGTCATAGGA-3'     (SEQ ID NO: 942)
get:
```

TABLE 7-continued

Selected Human Anti-MET "Blunt/Fray" DsiRNAs

```
                5'-UUGUGCAUUUCAAUGAAGUCAUAGG C^C-3'    (SEQ ID NO: 2023)
                3'-AACACGUAAAGUUACUUCAGUAUCC U_U-5'    (SEQ ID NO: 583)

MET-3497 Tar-   5'-TTGTGCATTTCAATGAAGTCATAGGAA-3'      (SEQ ID NO: 943)
get:

5'-UGUGCAUUUCAAUGAAGUCAUAGGA C^A-3'    (SEQ ID NO: 2024)
                3'-ACACGUAAAGUUACUUCAGUAUCCU U_C-5'    (SEQ ID NO: 584)

MET-3498 Tar-   5'-TGTGCATTTCAATGAAGTCATAGGAAG-3'      (SEQ ID NO: 944)
get:

5'-GUGCAUUUCAAUGAAGUCAUAGGAA A^C-3'    (SEQ ID NO: 2025)
                3'-CACGUAAAGUUACUUCAGUAUCCUU C_U-5'    (SEQ ID NO: 585)

MET-3499 Tar-   5'-GTGCATTTCAATGAAGTCATAGGAAGA-3'      (SEQ ID NO: 945)
get:

5'-UGCAUUUCAAUGAAGUCAUAGGAAG C^A-3'    (SEQ ID NO: 2026)
                3'-ACGUAAAGUUACUUCAGUAUCCUUC U_C-5'    (SEQ ID NO: 586)

MET-3500 Tar-   5'-TGCATTTCAATGAAGTCATAGGAAGAG-3'      (SEQ ID NO: 946)
get:

5'-GCAUUUCAAUGAAGUCAUAGGAAGA A^A-3'    (SEQ ID NO: 2027)
                3'-CGUAAAGUUACUUCAGUAUCCUUCU C_C-5'    (SEQ ID NO: 587)

MET-3501 Tar-   5'-GCATTTCAATGAAGTCATAGGAAGAGG-3'      (SEQ ID NO: 947)
get:

5'-CAUUUCAAUGAAGUCAUAGGAAGAG A^A-3'    (SEQ ID NO: 2028)
                3'-GUAAAGUUACUUCAGUAUCCUUCUC C_C-5'    (SEQ ID NO: 588)

MET-3502 Tar-   5'-CATTTCAATGAAGTCATAGGAAGAGGG-3'      (SEQ ID NO: 948)
get:

5'-AUUUCAAUGAAGUCAUAGGAAGAGG A^A-3'    (SEQ ID NO: 2029)
                3'-UAAAGUUACUUCAGUAUCCUUCUCC C_G-5'    (SEQ ID NO: 589)

MET-3503 Tar-   5'-ATTTCAATGAAGTCATAGGAAGAGGGC-3'      (SEQ ID NO: 949)
get:

5'-UUUCAAUGAAGUCAUAGGAAGAGGG A^C-3'    (SEQ ID NO: 2030)
                3'-AAAGUUACUUCAGUAUCCUUCUCCC G_U-5'    (SEQ ID NO: 590)

MET-3504 Tar-   5'-TTTCAATGAAGTCATAGGAAGAGGGCA-3'      (SEQ ID NO: 950)
get:

5'-UUCAAUGAAGUCAUAGGAAGAGGGC C^C-3'    (SEQ ID NO: 2031)
                3'-AAGUUACUUCAGUAUCCUUCUCCCG U_A-5'    (SEQ ID NO: 591)

MET-3505 Tar-   5'-TTCAATGAAGTCATAGGAAGAGGGCAT-3'      (SEQ ID NO: 951)
get:

5'-UCAAUGAAGUCAUAGGAAGAGGGCA C^C-3'    (SEQ ID NO: 2032)
                3'-AGUUACUUCAGUAUCCUUCUCCCGU A_A-5'    (SEQ ID NO: 592)

MET-3506 Tar-   5'-TCAATGAAGTCATAGGAAGAGGGCATT-3'      (SEQ ID NO: 952)
get:

5'-CAAUGAAGUCAUAGGAAGAGGGCAU C^C-3'    (SEQ ID NO: 2033)
                3'-GUUACUUCAGUAUCCUUCUCCCGUA A_A-5'    (SEQ ID NO: 593)

MET-3507 Tar-   5'-CAATGAAGTCATAGGAAGAGGGCATTT-3'      (SEQ ID NO: 953)
get:
```

TABLE 7-continued

Selected Human Anti-MET "Blunt/Fray" DsiRNAs

```
                5'-AAUGAAGUCAUAGGAAGAGGGCAUU C^C-3'   (SEQ ID NO: 2034)
                3'-UUACUUCAGUAUCCUUCUCCCGUAA A^A-5'   (SEQ ID NO: 594)

MET-3508 Tar-   5'-AATGAAGTCATAGGAAGAGGGCATTTT-3'   (SEQ ID NO: 954)
get:

5'-AUGAAGUCAUAGGAAGAGGGCAUUU C^A-3'   (SEQ ID NO: 2035)
                3'-UACUUCAGUAUCCUUCUCCCGUAAA A^C-5'   (SEQ ID NO: 595)

MET-3509 Tar-   5'-ATGAAGTCATAGGAAGAGGGCATTTTG-3'   (SEQ ID NO: 955)
get:

5'-UGAAGUCAUAGGAAGAGGGCAUUUU A^A-3'   (SEQ ID NO: 2036)
                3'-ACUUCAGUAUCCUUCUCCCGUAAAA C^C-5'   (SEQ ID NO: 596)

MET-3510 Tar-   5'-TGAAGTCATAGGAAGAGGGCATTTTGG-3'   (SEQ ID NO: 956)
get:

5'-GAAGUCAUAGGAAGAGGGCAUUUUG A^C-3'   (SEQ ID NO: 2037)
                3'-CUUCAGUAUCCUUCUCCCGUAAAAC C^A-5'   (SEQ ID NO: 597)

MET-3511 Tar-   5'-GAAGTCATAGGAAGAGGGCATTTTGGT-3'   (SEQ ID NO: 957)
get:

5'-AAGUCAUAGGAAGAGGGCAUUUUGG C^C-3'   (SEQ ID NO: 2038)
                3'-UUCAGUAUCCUUCUCCCGUAAAACC A^A-5'   (SEQ ID NO: 598)

MET-3512 Tar-   5'-AAGTCATAGGAAGAGGGCATTTTGGTT-3'   (SEQ ID NO: 958)
get:

5'-AGUCAUAGGAAGAGGGCAUUUUGGU C^A-3'   (SEQ ID NO: 2039)
                3'-UCAGUAUCCUUCUCCCGUAAAACCA A^C-5'   (SEQ ID NO: 599)

MET-3513 Tar-   5'-AGTCATAGGAAGAGGGCATTTTGGTTG-3'   (SEQ ID NO: 959)
get:

5'-GUCAUAGGAAGAGGGCAUUUUGGUU A^C-3'   (SEQ ID NO: 2040)
                3'-CAGUAUCCUUCUCCCGUAAAACCAA C^A-5'   (SEQ ID NO: 600)

MET-3514 Tar-   5'-GTCATAGGAAGAGGGCATTTTGGTTGT-3'   (SEQ ID NO: 960)
get:

5'-UCAUAGGAAGAGGGCAUUUUGGUUG C^A-3'   (SEQ ID NO: 2041)
                3'-AGUAUCCUUCUCCCGUAAAACCAAC A^C-5'   (SEQ ID NO: 601)

MET-3515 Tar-   5'-TCATAGGAAGAGGGCATTTTGGTTGTG-3'   (SEQ ID NO: 961)
get:

5'-GCAAGAAAAUUCACUGUGCUGUGAA C^C-3'   (SEQ ID NO: 2042)
                3'-CGUUCUUUUAAGUGACACGACACUU U^A-5'   (SEQ ID NO: 602)

MET-3572 Tar-   5'-GCAAGAAAATTCACTGTGCTGTGAAAT-3'   (SEQ ID NO: 962)
get:

5'-CAAGAAAAUUCACUGUGCUGUGAAA C^A-3'   (SEQ ID NO: 2043)
                3'-GUUCUUUUAAGUGACACGACACUUU A^G-5'   (SEQ ID NO: 603)

MET-3573 Tar-   5'-CAAGAAAATTCACTGTGCTGTGAAATC-3'   (SEQ ID NO: 963)
get:

5'-AAGAAAAUUCACUGUGCUGUGAAAU A^A-3'   (SEQ ID NO: 2044)
                3'-UUCUUUUAAGUGACACGACACUUUA G^G-5'   (SEQ ID NO: 604)

MET-3574 Tar-   5'-AAGAAAATTCACTGTGCTGTGAAATCC-3'   (SEQ ID NO: 964)
get:
```

TABLE 7-continued

Selected Human Anti-MET "Blunt/Fray" DsiRNAs

|  |  |
|---|---|
|  | 5'-AGAAAAUUCACUGUGCUGUGAAAUC A$^C$-3' (SEQ ID NO: 2045)<br>3'-UCUUUUAAGUGACACGACACUUUAG G$_A$-5' (SEQ ID NO: 605) |
| MET-3575 Target: | 5'-AGAAAATTCACTGTGCTGTGAAATCCT-3' (SEQ ID NO: 965) |
|  | 5'-GAAAAUUCACUGUGCUGUGAAAUCC C$^C$-3' (SEQ ID NO: 2046)<br>3'-CUUUUAAGUGACACGACACUUUAGG $_A$A-5' (SEQ ID NO: 606) |
| MET-3576 Target: | 5'-GAAAATTCACTGTGCTGTGAAATCCTT-3' (SEQ ID NO: 966) |
|  | 5'-AAAAUUCACUGUGCUGUGAAAUCCU C$^A$-3' (SEQ ID NO: 2047)<br>3'-UUUUAAGUGACACGACACUUUAGGA A$_C$-5' (SEQ ID NO: 607) |
| MET-3577 Target: | 5'-AAAATTCACTGTGCTGTGAAATCCTTG-3' (SEQ ID NO: 967) |
|  | 5'-AAAUUCACUGUGCUGUGAAAUCCUU A$^C$-3' (SEQ ID NO: 2048)<br>3'-UUUAAGUGACACGACACUUUAGGAA C$_U$-5' (SEQ ID NO: 608) |
| MET-3578 Target: | 5'-AAATTCACTGTGCTGTGAAATCCTTGA-3' (SEQ ID NO: 968) |
|  | 5'-AAUUCACUGUGCUGUGAAAUCCUUG C$^C$-3' (SEQ ID NO: 2049)<br>3'-UUAAGUGACACGACACUUUAGGAAC U$_U$-5' (SEQ ID NO: 609) |
| MET-3579 Target: | 5'-AATTCACTGTGCTGTGAAATCCTTGAA-3' (SEQ ID NO: 969) |
|  | 5'-AUUCACUGUGCUGUGAAAUCCUUGA C$^A$-3' (SEQ ID NO: 2050)<br>3'-UAAGUGACACGACACUUUAGGAACU U$_G$-5' (SEQ ID NO: 610) |
| MET-3580 Target: | 5'-ATTCACTGTGCTGTGAAATCCTTGAAC-3' (SEQ ID NO: 970) |
|  | 5'-UUCACUGUGCUGUGAAAUCCUUGAA A$^C$-3' (SEQ ID NO: 2051)<br>3'-AAGUGACACGACACUUUAGGAACUU G$_U$-5' (SEQ ID NO: 611) |
| MET-3581 Target: | 5'-TTCACTGTGCTGTGAAATCCTTGAACA-3' (SEQ ID NO: 971) |
|  | 5'-UCACUGUGCUGUGAAAUCCUUGAAC C$^A$-3' (SEQ ID NO: 2052)<br>3'-AGUGACACGACACUUUAGGAACUUG U$_C$-5' (SEQ ID NO: 612) |
| MET-3582 Target: | 5'-TCACTGTGCTGTGAAATCCTTGAACAG-3' (SEQ ID NO: 972) |
|  | 5'-CCGAGGGAAUCAUCAUGAAAGAUUU C$^C$-3' (SEQ ID NO: 2053)<br>3'-GGCUCCCUUAGUAGUACUUUCUAAA A$_U$-5' (SEQ ID NO: 613) |
| MET-3644 Target: | 5'-CCGAGGGAATCATCATGAAAGATTTTA-3' (SEQ ID NO: 973) |
|  | 5'-CGAGGGAAUCAUCAUGAAAGAUUUU C$^A$-3' (SEQ ID NO: 2054)<br>3'-GCUCCCUUAGUAGUACUUUCUAAAA U$_C$-5' (SEQ ID NO: 614) |
| MET-3645 Target: | 5'-CGAGGGAATCATCATGAAAGATTTTAG-3' (SEQ ID NO: 974) |
|  | 5'-AUGAGACUCAUAAUCCAACUGUAAA C$^A$-3' (SEQ ID NO: 2055)<br>3'-UACUCUGAGUAUUAGGUUGACAUUU U$_C$-5' (SEQ ID NO: 615) |
| MET-3779 Target: | 5'-ATGAGACTCATAATCCAACTGTAAAAG-3' (SEQ ID NO: 975) |

TABLE 7-continued

Selected Human Anti-MET "Blunt/Fray" DsiRNAs

```
                5'-UGAGACUCAUAAUCCAACUGUAAAA A^C -3'   (SEQ ID NO: 2056)
                3'-ACUCUGAGUAUUAGGUUGACAUUUU  C_U -5'  (SEQ ID NO: 616)

MET-3780 Tar-   5'-TGAGACTCATAATCCAACTGTAAAGA-3'        (SEQ ID NO: 976)
get:

5'-AACUGUAAAAGAUCUUAUUGGCUUU A^A -3'    (SEQ ID NO: 2057)
                3'-UUGACAUUUUCUAGAAUAACCGAAA C_C -5'   (SEQ ID NO: 617)

MET-3795 Tar-   5'-AACTGTAAAAGATCTTATTGGCTTTGG-3'       (SEQ ID NO: 977)
get:

5'-UUGGCUUUGGUCUUCAAGUAGCCAA C^A -3'    (SEQ ID NO: 2058)
                3'-AACCGAAACCAGAAGUUCAUCGGUU  U_C -5'   (SEQ ID NO: 618)

MET-3812 Tar-   5'-TTGGCTTTGGTCTTCAAGTAGCCAAAG-3'      (SEQ ID NO: 978)
get:

5'-GUCUUCAAGUAGCCAAAGGCAUGAA C^C -3'    (SEQ ID NO: 2059)
                3'-CAGAAGUUCAUCGGUUUCCGUACUU U_A -5'   (SEQ ID NO: 619)

MET-3821 Tar-   5'-GTCTTCAAGTAGCCAAAGGCATGAAAT-3'      (SEQ ID NO: 979)
get:

5'-UCUUCAAGUAGCCAAAGGCAUGAAA C^C -3'    (SEQ ID NO: 2060)
                3'-AGAAGUUCAUCGGUUUCCGUACUUU A_U -5'   (SEQ ID NO: 620)

MET-3822 Tar-   5'-TCTTCAAGTAGCCAAAGGCATGAAATA-3'      (SEQ ID NO: 980)
get:

5'-CUUCAAGUAGCCAAAGGCAUGAAAU C^C -3'    (SEQ ID NO: 2061)
                3'-GAAGUUCAUCGGUUUCCGUACUUUA U_A -5'   (SEQ ID NO: 621)

MET-3823 Tar-   5'-CTTCAAGTAGCCAAAGGCATGAAATAT-3'      (SEQ ID NO: 981)
get:

5'-UUCAAGUAGCCAAAGGCAUGAAAUA C^A -3'    (SEQ ID NO: 2062)
                3'-AAGUUCAUCGGUUUCCGUACUUUAU A_G -5'   (SEQ ID NO: 622)

MET-3824 Tar-   5'-TTCAAGTAGCCAAAGGCATGAAATATC-3'      (SEQ ID NO: 982)
get:

5'-UCAAGUAGCCAAAGGCAUGAAAUAU A^C -3'    (SEQ ID NO: 2063)
                3'-AGUUCAUCGGUUUCCGUACUUUAUA G_A -5'   (SEQ ID NO: 623)

MET-3825 Tar-   5'-TCAAGTAGCCAAAGGCATGAAATATCT-3'      (SEQ ID NO: 983)
get:

5'-CAAGUAGCCAAAGGCAUGAAAUAUC C^C -3'    (SEQ ID NO: 2064)
                3'-GUUCAUCGGUUUCCGUACUUUAUAG A_A -5'   (SEQ ID NO: 624)

MET-3826 Tar-   5'-CAAGTAGCCAAAGGCATGAAATATCTT-3'      (SEQ ID NO: 984)
get:

5'-AAGUAGCCAAAGGCAUGAAAUAUCU C^A -3'    (SEQ ID NO: 2065)
                3'-UUCAUCGGUUUCCGUACUUUAUAGA A_C -5'   (SEQ ID NO: 625)

MET-3827 Tar-   5'-AAGTAGCCAAAGGCATGAAATATCTTG-3'      (SEQ ID NO: 985)
get:

5'-AGUAGCCAAAGGCAUGAAAUAUCUU A^A -3'    (SEQ ID NO: 2066)
                3'-UCAUCGGUUUCCGUACUUUAUAGAA C_G -5'   (SEQ ID NO: 626)

MET-3828 Tar-   5'-AGTAGCCAAAGGCATGAAATATCTTGC-3'      (SEQ ID NO: 986)
get:
```

TABLE 7-continued

Selected Human Anti-MET "Blunt/Fray" DsiRNAs

|  |  |  |
|---|---|---|
|  | 5'-GUAGCCAAAGGCAUGAAAUAUCUUG A<sup>C</sup>-3' | (SEQ ID NO: 2067) |
|  | 3'-CAUCGGUUUCCGUACUUUAUAGAAC G<sub>U</sub>-5' | (SEQ ID NO: 627) |

MET-3829 Target:  5'-GTAGCCAAAGGCATGAAATATCTTGCA-3' (SEQ ID NO: 987)

5'-UAGCCAAAGGCAUGAAAUAUCUUGC C<sup>C</sup>-3' (SEQ ID NO: 2068)
3'-AUCGGUUUCCGUACUUUAUAGAACG U<sub>U</sub>-5' (SEQ ID NO: 628)

MET-3830 Target:  5'-TAGCCAAAGGCATGAAATATCTTGCAA-3' (SEQ ID NO: 988)

5'-AGCCAAAGGCAUGAAAUAUCUUGCA C<sup>A</sup>-3' (SEQ ID NO: 2069)
3'-UCGGUUUCCGUACUUUAUAGAACGU U<sub>C</sub>-5' (SEQ ID NO: 629)

MET-3831 Target:  5'-AGCCAAAGGCATGAAATATCTTGCAAG-3' (SEQ ID NO: 989)

5'-GCCAAAGGCAUGAAAUAUCUUGCAA A<sup>A</sup>-3' (SEQ ID NO: 2070)
3'-CGGUUUCCGUACUUUAUAGAACGUU C<sub>G</sub>-5' (SEQ ID NO: 630)

MET-3832 Target:  5'-GCCAAAGGCATGAAATATCTTGCAAGC-3' (SEQ ID NO: 990)

5'-CCAAAGGCAUGAAAUAUCUUGCAAG A<sup>C</sup>-3' (SEQ ID NO: 2071)
3'-GGUUUCCGUACUUUAUAGAACGUUC G<sub>U</sub>-5' (SEQ ID NO: 631)

MET-3833 Target:  5'-CCAAAGGCATGAAATATCTTGCAAGCA-3' (SEQ ID NO: 991)

5'-CAAAGGCAUGAAAUAUCUUGCAAGC C<sup>C</sup>-3' (SEQ ID NO: 2072)
3'-GUUUCCGUACUUUAUAGAACGUUCG U<sub>U</sub>-5' (SEQ ID NO: 632)

MET-3834 Target:  5'-CAAAGGCATGAAATATCTTGCAAGCAA-3' (SEQ ID NO: 992)

5'-CAAGCAAAAGUUUGUCCACAGAGA A<sup>C</sup>-3' (SEQ ID NO: 2073)
3'-GUUCGUUUUCAAACAGGUGUCUCU G<sub>A</sub>-5' (SEQ ID NO: 633)

MET-3854 Target:  5'-CAAGCAAAAGTTTGTCCACAGAGACT-3' (SEQ ID NO: 993)

5'-AAGCAAAAGUUUGUCCACAGAGAC C<sup>C</sup>-3' (SEQ ID NO: 2074)
3'-UUCGUUUUCAAACAGGUGUCUCUG A<sub>A</sub>-5' (SEQ ID NO: 634)

MET-3855 Target:  5'-AAGCAAAAGTTTGTCCACAGAGACTT-3' (SEQ ID NO: 994)

5'-AGCAAAAGUUUGUCCACAGAGACU C<sup>A</sup>-3' (SEQ ID NO: 2075)
3'-UCGUUUUCAAACAGGUGUCUCUGA A<sub>C</sub>-5' (SEQ ID NO: 635)

MET-3856 Target:  5'-AGCAAAAGTTTGTCCACAGAGACTTG-3' (SEQ ID NO: 995)

5'-GCAAAAGUUUGUCCACAGAGACUU A<sup>A</sup>-3' (SEQ ID NO: 2076)
3'-CGUUUUCAAACAGGUGUCUCUGAA C<sub>C</sub>-5' (SEQ ID NO: 636)

MET-3857 Target:  5'-GCAAAAGTTTGTCCACAGAGACTTGG-3' (SEQ ID NO: 996)

5'-CAAAAGUUUGUCCACAGAGACUUG A<sup>A</sup>-3' (SEQ ID NO: 2077)
3'-GUUUUCAAACAGGUGUCUCUGAAC C<sub>G</sub>-5' (SEQ ID NO: 637)

MET-3858 Target:  5'-CAAAAGTTTGTCCACAGAGACTTGGC-3' (SEQ ID NO: 997)

TABLE 7-continued

Selected Human Anti-MET "Blunt/Fray" DsiRNAs

```
                    5'-AAAAAGUUUGUCCACAGAGACUUGG A C-3'   (SEQ ID NO: 2078)
                    3'-UUUUUCAAACAGGUGUCUCUGAACC G A-5'   (SEQ ID NO: 638)

MET-3859 Tar-       5'-AAAAAGTTTGTCCACAGAGACTTGGCT-3'     (SEQ ID NO: 998)
get:

5'-AAAAGUUUGUCCACAGAGACUUGGC C A-3'   (SEQ ID NO: 2079)
                    3'-UUUUCAAACAGGUGUCUCUGAACCG A C-5'   (SEQ ID NO: 639)

MET-3860 Tar-       5'-AAAAGTTTGTCCACAGAGACTTGGCTG-3'     (SEQ ID NO: 999)
get:

5'-AAAGUUUGUCCACAGAGACUUGGCU A A-3'   (SEQ ID NO: 2080)
                    3'-UUUCAAACAGGUGUCUCUGAACCGA C G-5'   (SEQ ID NO: 640)

MET-3861 Tar-       5'-AAAGTTTGTCCACAGAGACTTGGCTGC-3'     (SEQ ID NO: 1000)
get:

5'-GACUUGGCUGCAAGAAACUGUAUGC C A-3'   (SEQ ID NO: 2081)
                    3'-CUGAACCGACGUUCUUUGACAUACG A C-5'   (SEQ ID NO: 641)

MET-3877 Tar-       5'-GACTTGGCTGCAAGAAACTGTATGCTG-3'     (SEQ ID NO: 1001)
get:

5'-CUUGGCUGCAAGAAACUGUAUGCUG A C-3'   (SEQ ID NO: 2082)
                    3'-GAACCGACGUUCUUUGACAUACGAC C U-5'   (SEQ ID NO: 642)

MET-3879 Tar-       5'-CTTGGCTGCAAGAAACTGTATGCTGGA-3'     (SEQ ID NO: 1002)
get:

5'-UUGGCUGCAAGAAACUGUAUGCUGG C C-3'   (SEQ ID NO: 2083)
                    3'-AACCGACGUUCUUUGACAUACGACC U A-5'   (SEQ ID NO: 643)

MET-3880 Tar-       5'-TTGGCTGCAAGAAACTGTATGCTGGAT-3'     (SEQ ID NO: 1003)
get:

5'-UGGCUGCAAGAAACUGUAUGCUGGA C A-3'   (SEQ ID NO: 2084)
                    3'-ACCGACGUUCUUUGACAUACGACCU A C-5'   (SEQ ID NO: 644)

MET-3881 Tar-       5'-TGGCTGCAAGAAACTGTATGCTGGATG-3'     (SEQ ID NO: 1004)
get:

5'-GGCUGCAAGAAACUGUAUGCUGGAU A C-3'   (SEQ ID NO: 2085)
                    3'-CCGACGUUCUUUGACAUACGACCUA C U-5'   (SEQ ID NO: 645)

MET-3882 Tar-       5'-GGCTGCAAGAAACTGTATGCTGGATGA-3'     (SEQ ID NO: 1005)
get:

5'-CAGUCAAGGUUGCUGAUUUUGGUCU C A-3'   (SEQ ID NO: 2086)
                    3'-GUCAGUUCCAACGACUAAAACCAGA A C-5'   (SEQ ID NO: 646)

MET-3917 Tar-       5'-CAGTCAAGGTTGCTGATTTTGGTCTTG-3'     (SEQ ID NO: 1006)
get:

5'-AAGGUUGCUGAUUUUGGUCUUGCCA A C-3'   (SEQ ID NO: 2087)
                    3'-UUCCAACGACUAAAACCAGAACGGU C U-5'   (SEQ ID NO: 647)

MET-3922 Tar-       5'-AAGGTTGCTGATTTTGGTCTTGCCAGA-3'     (SEQ ID NO: 1007)
get:

5'-GGUUGCUGAUUUUGGUCUUGCCAGA A C-3'   (SEQ ID NO: 2088)
                    3'-CCAACGACUAAAACCAGAACGGUCU C U-5'   (SEQ ID NO: 648)

MET-3924 Tar-       5'-GGTTGCTGATTTTGGTCTTGCCAGAGA-3'     (SEQ ID NO: 1008)
get:
```

TABLE 7-continued

Selected Human Anti-MET "Blunt/Fray" DsiRNAs

```
                  5'-UUGGUCUUGCCAGAGACAUGUAUGA C C-3'    (SEQ ID NO: 2089)
                  3'-AACCAGAACGGUCUCUGUACAUACU A U-5'    (SEQ ID NO: 649)

MET-3935 Tar-     5'-TTGGTCTTGCCAGAGACATGTATGATA-3'      (SEQ ID NO: 1009)
get:

5'-UGGUCUUGCCAGAGACAUGUAUGAU C C-3'    (SEQ ID NO: 2090)
                  3'-ACCAGAACGGUCUCUGUACAUACUA U U-5'    (SEQ ID NO: 650)

MET-3936 Tar-     5'-TGGTCTTGCCAGAGACATGTATGATAA-3'      (SEQ ID NO: 1010)
get:

5'-AAGCUGCCAGUGAAGUGGAUGGCUU C A-3'    (SEQ ID NO: 2091)
                  3'-UUCGACGGUCACUUCACCUACCGAA A C-5'    (SEQ ID NO: 651)

MET-3997 Tar-     5'-AAGCTGCCAGTGAAGTGGATGGCTTTG-3'      (SEQ ID NO: 1011)
get:

5'-AGCUGCCAGUGAAGUGGAUGGCUUU A A-3'    (SEQ ID NO: 2092)
                  3'-UCGACGGUCACUUCACCUACCGAAA C C-5'    (SEQ ID NO: 652)

MET-3998 Tar-     5'-AGCTGCCAGTGAAGTGGATGGCTTTGG-3'      (SEQ ID NO: 1012)
get:

5'-AAGUGGAUGGCUUUGGAAAGUCUGC C C-3'    (SEQ ID NO: 2093)
                  3'-UUCACCUACCGAAACCUUUCAGACG U U-5'    (SEQ ID NO: 653)

MET-4009 Tar-     5'-AAGTGGATGGCTTTGGAAAGTCTGCAA-3'      (SEQ ID NO: 1013)
get:

5'-GUGGAUGGCUUUGGAAAGUCUGCAA C A-3'    (SEQ ID NO: 2094)
                  3'-CACCUACCGAAACCUUUCAGACGUU U G-5'    (SEQ ID NO: 654)

MET-4011 Tar-     5'-GTGGATGGCTTTGGAAAGTCTGCAAAC-3'      (SEQ ID NO: 1014)
get:

5'-GCUUUGGAAAGUCUGCAAACUCAAA C A-3'    (SEQ ID NO: 2095)
                  3'-CGAAACCUUUCAGACGUUUGAGUUU U C-5'    (SEQ ID NO: 655)

MET-4018 Tar-     5'-GCTTTGGAAAGTCTGCAAACTCAAAG-3'       (SEQ ID NO: 1015)
get:

5'-UCCUUUGGCGUGCUCCUCUGGGAGC C A-3'    (SEQ ID NO: 2096)
                  3'-AGGAAACCGCACGAGGAGACCCUCG A C-5'    (SEQ ID NO: 656)

MET-4069 Tar-     5'-TCCTTTGGCGTGCTCCTCTGGGAGCTG-3'      (SEQ ID NO: 1016)
get:

5'-CUUUGGCGUGCUCCUCUGGGAGCUG C C-3'    (SEQ ID NO: 2097)
                  3'-GAAACCGCACGAGGAGACCCUCGAC U A-5'    (SEQ ID NO: 657)

MET-4071 Target:  5'-CTTTGGCGTGCTCCTCTGGGAGCTGAT-3'      (SEQ ID NO: 1017)

5'-UUUGGCGUGCUCCUCUGGGAGCUGA C A-3'    (SEQ ID NO: 2098)
                  3'-AAACCGCACGAGGAGACCCUCGACU A C-5'    (SEQ ID NO: 658)

MET-4072 Tar-     5'-TTTGGCGTGCTCCTCTGGGAGCTGATG-3'      (SEQ ID NO: 1018)
get:

5'-UUGGCGUGCUCCUCUGGGAGCUGAU A C-3'    (SEQ ID NO: 2099)
                  3'-AACCGCACGAGGAGACCCUCGACUA C U-5'    (SEQ ID NO: 659)

MET-4073 Tar-     5'-TTGGCGTGCTCCTCTGGGAGCTGATGA-3'      (SEQ ID NO: 1019)
get:
```

TABLE 7-continued

Selected Human Anti-MET "Blunt/Fray" DsiRNAs

```
                5'-UGGCGUGCUCCUCUGGGAGCUGAUG C^A-3'  (SEQ ID NO: 2100)
                3'-ACCGCACGAGGAGACCCUCGACUAC U G-5'  (SEQ ID NO: 660)

MET-4074 Tar-   5'-TGGCGTGCTCCTCTGGGAGCTGATGAC-3'   (SEQ ID NO: 1020)
get:

5'-AUGUGAACGCUACUUAUGUGAACGU C^C-3'  (SEQ ID NO: 2101)
                3'-UACACUUGCGAUGAAUACACUUGCA U U-5'  (SEQ ID NO: 661)

MET-4319 Tar-   5'-ATGTGAACGCTACTTATGTGAACGTAA-3'   (SEQ ID NO: 1021)
get:

5'-UGUGAACGCUACUUAUGUGAACGUA C^C-3'  (SEQ ID NO: 2102)
                3'-ACACUUGCGAUGAAUACACUUGCAU U U-5'  (SEQ ID NO: 662)

MET-4320 Tar-   5'-TGTGAACGCTACTTATGTGAACGTAAA-3'   (SEQ ID NO: 1022)
get:

5'-CUCUGUUGUCAUCAGAAGAUAACGC C^A-3'  (SEQ ID NO: 2103)
                3'-GAGACAACAGUAGUCUUCUAUUGCG A C-5'  (SEQ ID NO: 663)

MET-4367 Tar-   5'-CTCTGTTGTCATCAGAAGATAACGCTG-3'   (SEQ ID NO: 1023)
get:

5'-CUUUGCUCUUGCCAAAAUUGCACUA C^C-3'  (SEQ ID NO: 2104)
                3'-GAAACGAGAACGGUUUUAACGUGAU A A-5'  (SEQ ID NO: 664)

MET-4523 Tar-   5'-CTTTGCTCTTGCCAAAATTGCACTATT-3'   (SEQ ID NO: 1024)
get:

5'-GUAUUGUUAUUUAAAUUACUGGAUU A^C-3'  (SEQ ID NO: 2105)
                3'-CAUAACAAUAAAUUUAAUGACCUAA G A-5'  (SEQ ID NO: 665)

MET-4559 Tar-   5'-GTATTGTTATTTAAATTACTGGATTCT-3'   (SEQ ID NO: 1025)
get:

5'-UACUGGAUUCUAAGGAAUUUCUUAU A^C-3'  (SEQ ID NO: 2106)
                3'-AUGACCUAAGAUUCCUUAAAGAAUA G A-5'  (SEQ ID NO: 666)

MET-4575 Tar-   5'-TACTGGATTCTAAGGAATTTCTTATCT-3'   (SEQ ID NO: 1026)
get:

5'-ACUGGAUUCUAAGGAAUUUCUUAUC C^A-3'  (SEQ ID NO: 2107)
                3'-UGACCUAAGAUUCCUUAAAGAAUAG A C-5'  (SEQ ID NO: 667)

MET-4576 Tar-   5'-ACTGGATTCTAAGGAATTTCTTATCTG-3'   (SEQ ID NO: 1027)
get:

5'-UGGGUUGAAUUUUUUAAAAAUCAGG C^C-3'  (SEQ ID NO: 2108)
                3'-ACCCAACUUAAAAAAUUUUUAGUCC A U-5'  (SEQ ID NO: 668)

MET-4703 Tar-   5'-TGGGTTGAATTTTTTAAAAATCAGGTA-3'   (SEQ ID NO: 1028)
get:

5'-GUAAACAUUCCCUUUUAAAUGUUUG C^C-3'  (SEQ ID NO: 2109)
                3'-CAUUUGUAAGGGAAAAUUUACAAAC A A-5'  (SEQ ID NO: 669)

MET-4935 Tar-   5'-GTAAACATTCCCTTTTAAATGTTTGTT-3'   (SEQ ID NO: 1029)
get:

5'-UUUUAAAUGUUUGUUUGUUUUUUGA A^C-3'  (SEQ ID NO: 2110)
                3'-AAAAUUUACAAACAAACAAAAAACU C U-5'  (SEQ ID NO: 670)

MET-4947 Tar-   5'-TTTTAAATGTTTGTTTGTTTTTTGAGA-3'   (SEQ ID NO: 1030)
get:
```

TABLE 7-continued

Selected Human Anti-MET "Blunt/Fray" DsiRNAs

|  |  |
|---|---|
|  | 5'-CAGGAUCUCACUCUGUUGCCAGGGC$^{CA}$-3' (SEQ ID NO: 2111)<br>3'-GUCCUAGAGUGAGACAACGGUCCCG$_{AC}$-5' (SEQ ID NO: 6671) |
| MET-4974 Target: | 5'-CAGGATCTCACTCTGTTGCCAGGGCTG-3' (SEQ ID NO: 1031) |
|  | 5'-GGAUCUCACUCUGUUGCCAGGGCUG$^{CC}$-3' (SEQ ID NO: 2112)<br>3'-CCUAGAGUGAGACAACGGUCCCGAC$_{AU}$-5' (SEQ ID NO: 672) |
| MET-4976 Target: | 5'-GGATCTCACTCTGTTGCCAGGGCTGTA-3' (SEQ ID NO: 1032) |
|  | 5'-CUCACUCUGUUGCCAGGGCUGUAGU$^{AA}$-3' (SEQ ID NO: 2113)<br>3'-GAGUGAGACAACGGUCCCGACAUCA$_{CG}$-5' (SEQ ID NO: 673) |
| MET-4980 Target: | 5'-CTCACTCTGTTGCCAGGGCTGTAGTGC-3' (SEQ ID NO: 1033) |
|  | 5'-CACUCUGUUGCCAGGGCUGUAGUGC$^{CA}$-3' (SEQ ID NO: 2114)<br>3'-GUGAGACAACGGUCCCGACAUCACG$_{UC}$-5' (SEQ ID NO: 674) |
| MET-4982 Target: | 5'-CACTCTGTTGCCAGGGCTGTAGTGCAG-3' (SEQ ID NO: 1034) |
|  | 5'-CUGUUGCCAGGGCUGUAGUGCAGUG$^{AC}$-3' (SEQ ID NO: 2115)<br>3'-GACAACGGUCCCGACAUCACGUCAC$_{CA}$-5' (SEQ ID NO: 675) |
| MET-4986 Target: | 5'-CTGTTGCCAGGGCTGTAGTGCAGTGGT-3' (SEQ ID NO: 1035) |
|  | 5'-GGCUGUAGUGCAGUGGUGUGAUCAU$^{CA}$-3' (SEQ ID NO: 2116)<br>3'-CCGACAUCACGUCACCACACUAGUA$_{UC}$-5' (SEQ ID NO: 676) |
| MET-4996 Target: | 5'-GGCTGTAGTGCAGTGGTGTGATCATAG-3' (SEQ ID NO: 1036) |
|  | 5'-GUGCAGUGGUGUGAUCAUAGCUCAC$^{CA}$-3' (SEQ ID NO: 2117)<br>3'-CACGUCACCACACUAGUAUCGAGUG$_{AC}$-5' (SEQ ID NO: 677) |
| MET-5003 Target: | 5'-GTGCAGTGGTGTGATCATAGCTCACTG-3' (SEQ ID NO: 1037) |
|  | 5'-CCGGCUAAUUUUUGUAUUUUUUGUA$^{AC}$-3' (SEQ ID NO: 2118)<br>3'-GGCCGAUUAAAAACAUAAAAAACAU$_{CU}$-5' (SEQ ID NO: 678) |
| MET-5094 Target: | 5'-CCGGCTAATTTTTGTATTTTTGTAGA-3' (SEQ ID NO: 1038) |
|  | 5'-CCUUAUAAAUUUUUGUAUAGACAUU$^{AA}$-3' (SEQ ID NO: 2119)<br>3'-GGAAUAUUUAAAAACAUAUCUGUAA$_{GG}$-5' (SEQ ID NO: 679) |
| MET-5234 Target: | 5'-CCTTATAAATTTTTGTATAGACATTCC-3' (SEQ ID NO: 1039) |
|  | 5'-GUUGGAAGAAUAUUUAUAGGCAAUA$^{AC}$-3' (SEQ ID NO: 2120)<br>3'-CAACCUUCUUAUAAAUAUCCGUUAU$_{GU}$-5' (SEQ ID NO: 680) |
| MET-5265 Target: | 5'-GTTGGAAGAATATTTATAGGCAATACA-3' (SEQ ID NO: 1040) |
|  | 5'-CACACAAAACAUGUUUAUAAAUGAA$^{AC}$-3' (SEQ ID NO: 2121)<br>3'-GUGUGUUUUGUACAAAUAUUUACUU$_{GU}$-5' (SEQ ID NO: 681) |
| MET-5313 Target: | 5'-CACACAAAACATGTTTATAAATGAACA-3' (SEQ ID NO: 1041) |

TABLE 7-continued

Selected Human Anti-MET "Blunt/Fray" DsiRNAs

```
                     5'-AUGACAUUAAGAAAAUUUGUAUGAA^C C-3'   (SEQ ID NO: 2122)
                     3'-UACUGUAAUUCUUUUAAACAUACUU_U A-5'   (SEQ ID NO: 682)

MET-5357 Tar-        5'-ATGACATTAAGAAAATTTGTATGAAAT-3'     (SEQ ID NO: 1042)
get:

5'-UUGUGUGUAUUUUUUUAAAUGAAAA^A C-3'   (SEQ ID NO: 2123)
                     3'-AACACACAUAAAAAAAUUUACUUUU_G A-5'   (SEQ ID NO: 683)

MET-5479 Tar-        5'-TTGTGTGTATTTTTTTAAATGAAAACT-3'     (SEQ ID NO: 1043)
get:

5'-AACUCAGCAUGUUUGUAAAGCAGGA^C C-3'   (SEQ ID NO: 2124)
                     3'-UUGAGUCGUACAAACAUUUCGUCCU_A U-5'   (SEQ ID NO: 684)

MET-5548 Tar-        5'-AACTCAGCATGTTTGTAAAGCAGGATA-3'     (SEQ ID NO: 1044)
get:

5'-UGGAUGGAUUGAAAAGAUUAGCCUC^C A-3'   (SEQ ID NO: 2125)
                     3'-ACCUACCUAACUUUUCUAAUCGGAG_A C-5'   (SEQ ID NO: 685)

MET-5634 Tar-        5'-TGGATGGATTGAAAAGATTAGCCTCTG-3'     (SEQ ID NO: 1045)
get:

5'-AUUCUGUGGAAUUUUGUGCUUGCUA^A C-3'   (SEQ ID NO: 2126)
                     3'-UAAGACACCUUAAAACACGAACGAU_G A-5'   (SEQ ID NO: 686)

MET-5847 Tar-        5'-ATTCTGTGGAATTTTGTGCTTGCTACT-3'    (SEQ ID NO: 1046)
get:

5'-UUCUGUGGAAUUUUGUGCUUGCUAC^C A-3'   (SEQ ID NO: 2127)
                     3'-AAGACACCUUAAAACACGAACGAUG_A C-5'   (SEQ ID NO: 687)

MET-5848 Tar-        5'-TTCTGTGGAATTTTGTGCTTGCTACTG-3'    (SEQ ID NO: 1047)
get:

5'-CUGUGGAAUUUUGUGCUUGCUACUG^C C-3'   (SEQ ID NO: 2128)
                     3'-GACACCUUAAAACACGAACGAUGAC_A U-5'   (SEQ ID NO: 688)

MET-5850 Tar-        5'-CTGTGGAATTTTGTGCTTGCTACTGTA-3'    (SEQ ID NO: 1048)
get:

5'-UGGAAUUUUGUGCUUGCUACUGUAU^C A-3'   (SEQ ID NO: 2129)
                     3'-ACCUUAAAACACGAACGAUGACAUA_U C-5'   (SEQ ID NO: 689)

MET-5853 Tar-        5'-TGGAATTTTGTGCTTGCTACTGTATAG-3'    (SEQ ID NO: 1049)
get:

5'-AAUUUUGUGCUUGCUACUGUAUAGU^A A-3'   (SEQ ID NO: 2130)
                     3'-UUAAAACACGAACGAUGACAUAUCA_C G-5'   (SEQ ID NO: 690)

MET-5856 Tar-        5'-AATTTTGTGCTTGCTACTGTATAGTGC-3'    (SEQ ID NO: 1050)
get:

5'-UUUUGUGCUUGCUACUGUAUAGUGC^C C-3'   (SEQ ID NO: 2131)
                     3'-AAAACACGAACGAUGACAUAUCACG_U A-5'   (SEQ ID NO: 691)

MET-5858 Tar-        5'-TTTTGTGCTTGCTACTGTATAGTGCAT-3'    (SEQ ID NO: 1051)
get:

5'-UUUGUGCUUGCUACUGUAUAGUGCA^C A-3'   (SEQ ID NO: 2132)
                     3'-AAACACGAACGAUGACAUAUCACGU_A C-5'   (SEQ ID NO: 692)

MET-5859 Tar-        5'-TTTGTGCTTGCTACTGTATAGTGCATG-3'    (SEQ ID NO: 1052)
get:
```

TABLE 7-continued

Selected Human Anti-MET "Blunt/Fray" DsiRNAs

```
                5'-UUGUGCUUGCUACUGUAUAGUGCAU^AC-3'   (SEQ ID NO: 2133)
                3'-AACACGAACGAUGACAUAUCACGUA_CA-5'   (SEQ ID NO: 693)

MET-5860 Tar-   5'-TTGTGCTTGCTACTGTATAGTGCATGT-3'    (SEQ ID NO: 1053)
get:

5'-UGUGCUUGCUACUGUAUAGUGCAUG^CA-3'   (SEQ ID NO: 2134)
                3'-ACACGAACGAUGACAUAUCACGUAC_AC-5'   (SEQ ID NO: 694)

MET-5861 Tar-   5'-TGTGCTTGCTACTGTATAGTGCATGTG-3'    (SEQ ID NO: 1054)
get:

5'-GUGCUUGCUACUGUAUAGUGCAUGU^AA-3'   (SEQ ID NO: 2135)
                3'-CACGAACGAUGACAUAUCACGUACA_CC-5'   (SEQ ID NO: 695)

MET-5862 Tar-   5'-GTGCTTGCTACTGTATAGTGCATGTGG-3'    (SEQ ID NO: 1055)
get:

5'-GCUUGCUACUGUAUAGUGCAUGUGG^CA-3'   (SEQ ID NO: 2136)
                3'-CGAACGAUGACAUAUCACGUACACC_AC-5'   (SEQ ID NO: 696)

MET-5864 Tar-   5'-GCTTGCTACTGTATAGTGCATGTGGTG-3'    (SEQ ID NO: 1056)
get:

5'-UUGCUACUGUAUAGUGCAUGUGGUG^CC-3'   (SEQ ID NO: 2137)
                3'-AACGAUGACAUAUCACGUACACCAC_AU-5'   (SEQ ID NO: 697)

MET-5866 Tar-   5'-TTGCTACTGTATAGTGCATGTGGTGTA-3'    (SEQ ID NO: 1057)
get:

5'-UGCUACUGUAUAGUGCAUGUGGUGU^CA-3'   (SEQ ID NO: 2138)
                3'-ACGAUGACAUAUCACGUACACCACA_UC-5'   (SEQ ID NO: 698)

MET-5867 Tar-   5'-TGCTACTGTATAGTGCATGTGGTGTAG-3'    (SEQ ID NO: 1058)
get:

5'-GCUACUGUAUAGUGCAUGUGGUGUA^AA-3'   (SEQ ID NO: 2139)
                3'-CGAUGACAUAUCACGUACACCACAU_CC-5'   (SEQ ID NO: 699)

MET-5868 Tar-   5'-GCTACTGTATAGTGCATGTGGTGTAGG-3'    (SEQ ID NO: 1059)
get:

5'-UAAACAUUUAAAGUGUUAUAUUUUU^CC-3'   (SEQ ID NO: 2140)
                3'-AUUUGUAAAUUUCACAAUAUAAAAA_AU-5'   (SEQ ID NO: 700)

MET-5919 Tar-   5'-TAAACATTTAAAGTGTTATATTTTTA-3'     (SEQ ID NO: 1060)
get:

5'-UAAAAAUGUUUAUUUUUAAUGAUAU^AC-3'   (SEQ ID NO: 2141)
                3'-AUUUUUACAAAUAAAAAUUACUAUA_CU-5'   (SEQ ID NO: 701)

MET-5946 Tar-   5'-TAAAAATGTTTATTTTTAATGATATGA-3'    (SEQ ID NO: 1061)
get:

5'-AAAAAUGUUUAUUUUUAAUGAUAUG^CA-3'   (SEQ ID NO: 2142)
                3'-UUUUUACAAAUAAAAAUUACUAUAC_UC-5'   (SEQ ID NO: 702)

MET-5947 Tar-   5'-AAAAATGTTTATTTTTAATGATATGAG-3'    (SEQ ID NO: 1062)
get:

5'-AAAAUGUUUAUUUUUAAUGAUAUGA^AC-3'   (SEQ ID NO: 2143)
                3'-UUUUACAAAUAAAAAUUACUAUACU_CU-5'   (SEQ ID NO: 703)

MET-5948 Tar-   5'-AAAATGTTTATTTTTAATGATATGAGA-3'    (SEQ ID NO: 1063)
get:
```

TABLE 7-continued

Selected Human Anti-MET "Blunt/Fray" DsiRNAs

```
                    5'-GCACUGUGAACAUUUUAGAAAAGGU ^C_C -3'   (SEQ ID NO: 2144)
                    3'-CGUGACACUUGUAAAAUCUUUUCCA _U^A -5'   (SEQ ID NO: 704)

MET-6002 Tar-       5'-GCACTGTGAACATTTTAGAAAAGGTAT-3'       (SEQ ID NO: 1064)
get:

5'-GCGAUAAGGAAAUGUACUGAUUGCC ^C_C -3'   (SEQ ID NO: 2145)
                    3'-CGCUAUUCCUUUACAUGACUAACGG _U^U -5'   (SEQ ID NO: 705)

MET-6075 Tar-       5'-GCGATAAGGAAATGTACTGATTGCCAA-3'       (SEQ ID NO: 1065)
get:

5'-CGAUAAGGAAAUGUACUGAUUGCCA ^C_C -3'   (SEQ ID NO: 2146)
                    3'-GCUAUUCCUUUACAUGACUAACGGU _U^A -5'   (SEQ ID NO: 706)

MET-6076 Target:    5'-CGATAAGGAAATGTACTGATTGCCAAT-3'       (SEQ ID NO: 1066)

5'-GAUAAGGAAAUGUACUGAUUGCCAA ^C_C -3'   (SEQ ID NO: 2147)
                    3'-CUAUUCCUUUACAUGACUAACGGUU _A^U -5'   (SEQ ID NO: 707)

MET-6077 Tar-       5'-GATAAGGAAATGTACTGATTGCCAATA-3'      (SEQ ID NO: 1067)
get:

5'-AUAAGGAAAUGUACUGAUUGCCAAU ^C_A -3'   (SEQ ID NO: 2148)
                    3'-UAUUCCUUUACAUGACUAACGGUUA _U^G -5'   (SEQ ID NO: 708)

MET-6078 Tar-       5'-ATAAGGAAATGTACTGATTGCCAATAC-3'      (SEQ ID NO: 1068)
get:

5'-UAAGGAAAUGUACUGAUUGCCAAUA ^A_C -3'   (SEQ ID NO: 2149)
                    3'-AUUCCUUUACAUGACUAACGGUUAU _G^U -5'   (SEQ ID NO: 709)

MET-6079 Tar-       5'-TAAGGAAATGTACTGATTGCCAATACA-3'      (SEQ ID NO: 1069)
get:

5'-AAGGAAAUGUACUGAUUGCCAAUAC ^C_A -3'   (SEQ ID NO: 2150)
                    3'-UUCCUUUACAUGACUAACGGUUAUG _U^G -5'   (SEQ ID NO: 710)

MET-6080 Tar-       5'-AAGGAAATGTACTGATTGCCAATACAC-3'      (SEQ ID NO: 1070)
get:

5'-AUCAGGACUUGAAGCCAAGGGUUAA ^A_A -3'   (SEQ ID NO: 2151)
                    3'-UAGUCCUGAACUUCGGUUCCCAAUU _G^G -5'   (SEQ ID NO: 711)

MET-6124 Tar-       5'-ATCAGGACTTGAAGCCAAGGGTTAACC-3'      (SEQ ID NO: 1071)
get:

5'-UCAGGACUUGAAGCCAAGGGUUAAC ^A_A -3'   (SEQ ID NO: 2152)
                    3'-AGUCCUGAACUUCGGUUCCCAAUUG _G^G -5'   (SEQ ID NO: 712)

MET-6125 Tar-       5'-TCAGGACTTGAAGCCAAGGGTTAACCC-3'      (SEQ ID NO: 1072)
get:

5'-CAGGACUUGAAGCCAAGGGUUAACC ^A_C -3'   (SEQ ID NO: 2153)
                    3'-GUCCUGAACUUCGGUUCCCAAUUGG _G^U -5'   (SEQ ID NO: 713)

MET-6126 Tar-       5'-CAGGACTTGAAGCCAAGGGTTAACCCA-3'      (SEQ ID NO: 1073)
get:

5'-AGGACUUGAAGCCAAGGGUUAACCC ^C_A -3'   (SEQ ID NO: 2154)
                    3'-UCCUGAACUUCGGUUCCCAAUUGGG _U^C -5'   (SEQ ID NO: 714)

MET-6127 Tar-       5'-AGGACTTGAAGCCAAGGGTTAACCCAG-3'      (SEQ ID NO: 1074)
get:
```

TABLE 7-continued

Selected Human Anti-MET "Blunt/Fray" DsiRNAs

```
                  5'-GGACUUGAAGCCAAGGGUUAACCCA A A-3'   (SEQ ID NO: 2155)
                  3'-CCUGAACUUCGGUUCCCAAUUGGGU C G-5'   (SEQ ID NO: 715)

MET-6128 Tar-     5'-GGACTTGAAGCCAAGGGTTAACCCAGC-3'    (SEQ ID NO: 1075)
get:

5'-UGCCGUUUCAUAAAUGUAAUAAGUA C C-3'   (SEQ ID NO: 2156)
                  3'-ACGGCAAAGUAUUUACAUUAUUCAU U A-5'   (SEQ ID NO: 716)

MET-6307 Tar-     5'-TGCCGTTTCATAAATGTAATAAGTAAT-3'    (SEQ ID NO: 1076)
get:

5'-UUUGCUAUUUAUAAACUUGUCCUUA A C-3'   (SEQ ID NO: 2157)
                  3'-AAACGAUAAAUAUUUGAACAGGAAU C U-5'   (SEQ ID NO: 717)

MET-6520 Tar-     5'-TTTGCTATTTATAAACTTGTCCTTAGA-3'    (SEQ ID NO: 1077)
get:

5'-ACUUGUCACUGCCAUACCUGCAGC C A-3'    (SEQ ID NO: 2158)
                  3'-UGAACAGUGACGGAUAUGGACGUCG A C-5'   (SEQ ID NO: 718)

MET-6599 Tar-     5'-ACTTGTCACTGCCATACCTGCAGCTG-3'    (SEQ ID NO: 1078)
get:

5'-CUUGUCACUGCCAUACCUGCAGCU A C-3'    (SEQ ID NO: 2159)
                  3'-GAACAGUGACGGAUAUGGACGUCGA C U-5'   (SEQ ID NO: 719)

MET-6600 Tar-     5'-CTTGTCACTGCCATACCTGCAGCTGA-3'    (SEQ ID NO: 1079)
get:

5'-UUGUCACUGCCAUACCUGCAGCUG C C-3'    (SEQ ID NO: 2160)
                  3'-AACAGUGACGGAUAUGGACGUCGAC U U-5'   (SEQ ID NO: 720)

MET-6601 Tar-     5'-TTGTCACTGCCATACCTGCAGCTGAA-3'    (SEQ ID NO: 1080)
get:
```

TABLE 8

Selected Mouse Anti-MET "Blunt/Fray" DsiRNAs

```
                  5'-CGGCCUCGCCGCCCGCAGCGUCCGA A A-3'   (SEQ ID NO: 2881)
                  3'-GCCGGAGCGGCGGGCGUCGCAGGCU C G-5'   (SEQ ID NO: 2593)

MET-m65 Target:   5'-CGGCCTCGCCGCCCGCAGCGTCCGAGC-3'    (SEQ ID NO: 2665)

5'-CUGUGCGGAGCCAGAUGCUGGGCGA A A-3'   (SEQ ID NO: 2882)
                  3'-GACACGCCUCGGUCUACGACCCGCU G G-5'   (SEQ ID NO: 2594)

MET-m102 Target:  5'-CTGTGCGGAGCCAGATGCTGGGCGACC-3'    (SEQ ID NO: 2666)

5'-GCGGAGCCAGAUGCUGGGCGACCGC C A-3'   (SEQ ID NO: 2883)
                  3'-CGCCUCGGUCUACGACCCGCUGGCG A C-5'   (SEQ ID NO: 2595)

MET-m106 Target:  5'-GCGGAGCCAGATGCTGGGCGACCGCTG-3'    (SEQ ID NO: 2667)

5'-AGAUGCUGGGCGACCGCUGACUCGC C A-3'   (SEQ ID NO: 2884)
                  3'-UCUACGACCCGCUGGCGACUGAGCG A C-5'   (SEQ ID NO: 2596)

MET-m114 Target:  5'-AGATGCTGGGCGACCGCTGACTCGCTG-3'    (SEQ ID NO: 2668)

5'-GAUGCUGGGCGACCGCUGACUCGCU A A-3'   (SEQ ID NO: 2885)
                  3'-CUACGACCCGCUGGCGACUGAGCGA C C-5'   (SEQ ID NO: 2597)

MET-m115 Target:  5'-GATGCTGGGCGACCGCTGACTCGCTGG-3'    (SEQ ID NO: 2669)
```

TABLE 8-continued

Selected Mouse Anti-MET "Blunt/Fray" DsiRNAs

```
                5'-UGCUGGGCGACCGCUGACUCGCUGG C A-3'    (SEQ ID NO: 2886)
                3'-ACGACCCGCUGGCGACUGAGCGACC U C-5'    (SEQ ID NO: 2598)

MET-m117 Target: 5'-TGCTGGGCGACCGCTGACTCGCTGGAG-3'     (SEQ ID NO: 2670)

5'-CCCAGCCGGCUGACUUCGGCGCCGC A A-3'    (SEQ ID NO: 2887)
                3'-GGGUCGGCCGACUGAAGCCGCGGCG C G-5'    (SEQ ID NO: 2599)

MET-m167 Target: 5'-CCCAGCCGGCTGACTTCGGCGCCGCGC-3'     (SEQ ID NO: 2671)

5'-CAGCCGGCUGACUUCGGCGCCGCGC A A-3'    (SEQ ID NO: 2888)
                3'-GUCGGCCGACUGAAGCCGCGGCGCG C G-5'    (SEQ ID NO: 2600)

MET-m169 Target: 5'-CAGCCGGCTGACTTCGGCGCCGCGCGC-3'     (SEQ ID NO: 2672)

5'-GCCGGCUGACUUCGGCGCCGCGCGC C A-3'    (SEQ ID NO: 2889)
                3'-CGGCCGACUGAAGCCGCGGCGCGCG A G-5'    (SEQ ID NO: 2601)

MET-m171 Target: 5'-GCCGGCTGACTTCGGCGCCGCGCGCTC-3'     (SEQ ID NO: 2673)

5'-AAGCUGACGGUGUAGCAGAACGCUU A A-3'    (SEQ ID NO: 2890)
                3'-UUCGACUGCCACAUCGUCUUGCGAA C C-5'    (SEQ ID NO: 2602)

MET-m335 Target: 5'-AAGCTGACGGTGTAGCAGAACGCTTGG-3'     (SEQ ID NO: 2674)

5'-AGCUGACGGUGUAGCAGAACGCUUG A A-3'    (SEQ ID NO: 2891)
                3'-UCGACUGCCACAUCGUCUUGCGAAC C G-5'    (SEQ ID NO: 2603)

MET-m336 Target: 5'-AGCTGACGGTGTAGCAGAACGCTTGGC-3'     (SEQ ID NO: 2675)

5'-CUGGCACCUGGCAUUCUGGUGCUGC C A-3'    (SEQ ID NO: 2892)
                3'-GACCGUGGACCGUAAGACCACGACG A C-5'    (SEQ ID NO: 2604)

MET-m400 Target: 5'-CTGGCACCTGGCATTCTGGTGCTGCTG-3'     (SEQ ID NO: 2676)

5'-GGCACCUGGCAUUCUGGUGCUGCUG C C-3'    (SEQ ID NO: 2893)
                3'-CCGUGGACCGUAAGACCACGACGAC A A-5'    (SEQ ID NO: 2605)

MET-m402 Target: 5'-GGCACCTGGCATTCTGGTGCTGCTGTT-3'     (SEQ ID NO: 2677)

5'-GCACCUGGCAUUCUGGUGCUGCUGU C A-3'    (SEQ ID NO: 2894)
                3'-CGUGGACCGUAAGACCACGACGACA A C-5'    (SEQ ID NO: 2606)

MET-m403 Target: 5'-GCACCTGGCATTCTGGTGCTGCTGTTG-3'     (SEQ ID NO: 2678)

5'-UUCUGGUGCUGCUGUUGUCCUUGGU A A-3'    (SEQ ID NO: 2895)
                3'-AAGACCACGACGACAACAGGAACCA C G-5'    (SEQ ID NO: 2607)

MET-m413 Target: 5'-TTCTGGTGCTGCTGTTGTCCTTGGTGC-3'     (SEQ ID NO: 2679)

5'-CUGGUGCUGCUGUUGUCCUUGGUGC C A-3'    (SEQ ID NO: 2896)
                3'-GACCACGACGACAACAGGAACCACG U C-5'    (SEQ ID NO: 2608)

MET-m415 Target: 5'-CTGGTGCTGCTGTTGTCCTTGGTGCAG-3'     (SEQ ID NO: 2680)

5'-UGGUGCUGCUGUUGUCCUUGGUGCA A C-3'    (SEQ ID NO: 2897)
                3'-ACCACGACGACAACAGGAACCACGU C U-5'    (SEQ ID NO: 2609)

MET-m416 Target: 5'-TGGTGCTGCTGTTGTCCTTGGTGCAGA-3'     (SEQ ID NO: 2681)

5'-UGCUGCUGUUGUCCUUGGUGCAGAG A C-3'    (SEQ ID NO: 2898)
                3'-ACGACGACAACAGGAACCACGUCUC C U-5'    (SEQ ID NO: 2610)

MET-m419 Target: 5'-TGCTGCTGTTGTCCTTGGTGCAGAGGA-3'     (SEQ ID NO: 2682)
```

TABLE 8-continued

Selected Mouse Anti-MET "Blunt/Fray" DsiRNAs

```
              5'-CUGUUCCGUAGACUCUGGGUUGCAC C A-3'      (SEQ ID NO: 2899)
              3'-GACAAGGCAUCUGAGACCCAACGUG A G-5'      (SEQ ID NO: 2611)

MET-m1221 Target: 5'-CTGTTCCGTAGACTCTGGGTTGCACTC-3'    (SEQ ID NO: 2683)

5'-GAGCACUGUUUCAAUAGGACCCUGC C A-3'      (SEQ ID NO: 2900)
              3'-CUCGUGACAAAGUUAUCCUGGGACG A C-5'      (SEQ ID NO: 2612)

MET-m1561 Target: 5'-GAGCACTGTTTCAATAGGACCCTGCTG-3'    (SEQ ID NO: 2684)

5'-AAACUCUUCCGGCUGUGAAGCGCGC C A-3'      (SEQ ID NO: 2901)
              3'-UUUGAGAAGGCCGACACUUCGCGCG U C-5'      (SEQ ID NO: 2613)

MET-m1590 Target: 5'-AAACTCTTCCGGCTGTGAAGCGCGCAG-3'    (SEQ ID NO: 2685)

5'-ACUCUUCCGGCUGUGAAGCGCGCAG C A-3'      (SEQ ID NO: 2902)
              3'-UGAGAAGGCCGACACUUCGCGCGUC A C-5'      (SEQ ID NO: 2614)

MET-m1592 Target: 5'-ACTCTTCCGGCTGTGAAGCGCGCAGTG-3'    (SEQ ID NO: 2686)

5'-UUUACCACGGCUUUGCAGCGCGUCG C A-3'      (SEQ ID NO: 2903)
              3'-AAAUGGUGCCGAAACGUCGCGCAGC U G-5'      (SEQ ID NO: 2615)

MET-m1636 Target: 5'-TTTACCACGGCTTTGCAGCGCGTCGAC-3'    (SEQ ID NO: 2687)

5'-UACCACGGCUUUGCAGCGCGUCGAC C C-3'      (SEQ ID NO: 2904)
              3'-AUGGUGCCGAAACGUCGCGCAGCUG A A-5'      (SEQ ID NO: 2616)

MET-m1638 Target: 5'-TACCACGGCTTTGCAGCGCGTCGACTT-3'    (SEQ ID NO: 2688)

5'-CACGGCUUUGCAGCGCGUCGACUUA C C-3'      (SEQ ID NO: 2905)
              3'-GUGCCGAAACGUCGCGCAGCUGAAU A A-5'      (SEQ ID NO: 2617)

MET-m1641 Target: 5'-CACGGCTTTGCAGCGCGTCGACTTATT-3'    (SEQ ID NO: 2689)

5'-CGGCUUUGCAGCGCGUCGACUUAUU A C-3'      (SEQ ID NO: 2906)
              3'-GCCGAAACGUCGCGCAGCUGAAUAA G U-5'      (SEQ ID NO: 2618)

MET-m1643 Target: 5'-CGGCTTTGCAGCGCGTCGACTTATTCA-3'    (SEQ ID NO: 2690)

5'-GGCUUUGCAGCGCGUCGACUUAUUC C C-3'      (SEQ ID NO: 2907)
              3'-CCGAAACGUCGCGCAGCUGAAUAAG U A-5'      (SEQ ID NO: 2619)

MET-m1644 Target: 5'-GGCTTTGCAGCGCGTCGACTTATTCAT-3'    (SEQ ID NO: 2691)

5'-GCUUUGCAGCGCGUCGACUUAUUCA C A-3'      (SEQ ID NO: 2908)
              3'-CGAAACGUCGCGCAGCUGAAUAAGU A C-5'      (SEQ ID NO: 2620)

MET-m1645 Target: 5'-GCTTTGCAGCGCGTCGACTTATTCATG-3'    (SEQ ID NO: 2692)

5'-CUUUGCAGCGCGUCGACUUAUUCAU A A-3'      (SEQ ID NO: 2909)
              3'-GAAACGUCGCGCAGCUGAAUAAGUA C C-5'      (SEQ ID NO: 2621)

MET-m1646 Target: 5'-CTTTGCAGCGCGTCGACTTATTCATGG-3'    (SEQ ID NO: 2693)

5'-GCGCGUCGACUUAUUCAUGGGCCGG A C-3'      (SEQ ID NO: 2910)
              3'-CGCGCAGCUGAAUAAGUACCCGGCC G A-5'      (SEQ ID NO: 2622)

MET-m1653 Target: 5'-GCGCGTCGACTTATTCATGGGCCGGCT-3'    (SEQ ID NO: 2694)

5'-GUCGCUUCAUGCAGGUGGUGCUCUC C A-3'      (SEQ ID NO: 2911)
              3'-CAGCGAAGUACGUCCACCACGAGAG A G-5'      (SEQ ID NO: 2623)

MET-m1757 Target: 5'-GTCGCTTCATGCAGGTGGTGCTCTCTC-3'    (SEQ ID NO: 2695)
```

TABLE 8-continued

Selected Mouse Anti-MET "Blunt/Fray" DsiRNAs

```
                5'-AGGUGGUGCUCUCUCGAACAGCACA^AA-3'   (SEQ ID NO: 2912)
                3'-UCCACCACGAGAGAGCUUGUCGUGU_GG-5'   (SEQ ID NO: 2624)

MET-m1769 Target: 5'-AGGTGGTGCTCTCTCGAACAGCACACC-3'  (SEQ ID NO: 2696)

5'-GUGGUGCUCUCUCGAACAGCACACC^CA-3'   (SEQ ID NO: 2913)
                3'-CACCACGAGAGAGCUUGUCGUGUGG_AG-5'   (SEQ ID NO: 2625)

MET-m1771 Target: 5'-GTGGTGCTCTCTCGAACAGCACACCTC-3' (SEQ ID NO: 2697)

5'-CUGCUUGGCAACGAGAGCUGUACCU^CA-3'   (SEQ ID NO: 2914)
                3'-GACGAACCGUUGCUCUCGACAUGGA_AC-5'   (SEQ ID NO: 2626)

MET-m2188 Target: 5'-CTGCTTGGCAACGAGAGCTGTACCTTG-3' (SEQ ID NO: 2698)

5'-UGCACUACUCCUUCACUGAAACAGC^CA-3'   (SEQ ID NO: 2915)
                3'-ACGUGAUGAGGAAGUGACUUUGUCG_AC-5'   (SEQ ID NO: 2627)

MET-m2779 Target: 5'-TGCACTACTCCTTCACTGAAACAGCTG-3' (SEQ ID NO: 2699)

5'-AGCAAGCAGUCUCUUCAACUGUUCU^CA-3'   (SEQ ID NO: 2916)
                3'-UCGUUCGUCAGAGAAGUUGACAAGA_AC-5'   (SEQ ID NO: 2628)

MET-m3113 Target: 5'-AGCAAGCAGTCTCTTCAACTGTTCTTG-3' (SEQ ID NO: 2700)

5'-GCAAGCAGUCUCUUCAACUGUUCUU^AA-3'   (SEQ ID NO: 2917)
                3'-CGUUCGUCAGAGAAGUUGACAAGAA_CC-5'   (SEQ ID NO: 2629)

MET-m3114 Target: 5'-GCAAGCAGTCTCTTCAACTGTTCTTGG-3' (SEQ ID NO: 2701)

5'-CAGUCUCUUCAACUGUUCUUGGAAA^CA-3'   (SEQ ID NO: 2918)
                3'-GUCAGAGAAGUUGACAAGAACCUUU_UC-5'   (SEQ ID NO: 2630)

MET-m3119 Target: 5'-CAGTCTCTTCAACTGTTCTTGGAAAAG-3' (SEQ ID NO: 2702)

5'-UCAGCACGUAGUGAUUGGACCCAGC^CA-3'   (SEQ ID NO: 2919)
                3'-AGUCGUGCAUCACUAACCUGGGUCG_UC-5'   (SEQ ID NO: 2631)

MET-m3573 Target: 5'-TCAGCACGTAGTGATTGGACCCAGCAG-3' (SEQ ID NO: 2703)

5'-UGGACCCAGCAGCCUGAUUGUGCAU^CC-3'   (SEQ ID NO: 2920)
                3'-ACCUGGGUCGUCGGACUAACACGUA_AA-5'   (SEQ ID NO: 2632)

MET-m3588 Target: 5'-TGGACCCAGCAGCCTGATTGTGCATTT-3' (SEQ ID NO: 2704)

5'-CUGUCAAGGUUGCUGAUUUCGGUCU^CA-3'   (SEQ ID NO: 2921)
                3'-GACAGUUCCAACGACUAAAGCCAGA_AC-5'   (SEQ ID NO: 2633)

MET-m4025 Target: 5'-CTGTCAAGGTTGCTGATTTCGGTCTTG-3' (SEQ ID NO: 2705)

5'-GGUUGCUGAUUUCGGUCUUGCCAGA^AC-3'   (SEQ ID NO: 2922)
                3'-CCAACGACUAAAGCCAGAACGGUCU_CU-5'   (SEQ ID NO: 2634)

MET-m4032 Target: 5'-GGTTGCTGATTTCGGTCTTGCCAGAGA-3' (SEQ ID NO: 2706)

5'-GUGCCAAGCUACCAGUAAAGUGGAU^AA-3'   (SEQ ID NO: 2923)
                3'-CACGGUUCGAUGGUCAUUUCACCUA_CC-5'   (SEQ ID NO: 2635)

MET-m4100 Target: 5'-GTGCCAAGCTACCAGTAAAGTGGATGG-3' (SEQ ID NO: 2707)

5'-CAAGCUACCAGUAAAGUGGAUGGCU^CC-3'   (SEQ ID NO: 2924)
                3'-GUUCGAUGGUCAUUUCACCUACCGA_AA-5'   (SEQ ID NO: 2636)

MET-m4104 Target: 5'-CAAGCTACCAGTAAAGTGGATGGCTTT-3' (SEQ ID NO: 2708)
```

TABLE 8-continued

Selected Mouse Anti-MET "Blunt/Fray" DsiRNAs

```
                   5'-AAGCUACCAGUAAAGUGGAUGGCUU C C-3'   (SEQ ID NO: 2925)
                   3'-UUCGAUGGUCAUUUCACCUACCGAA A U-5'   (SEQ ID NO: 2637)

MET-m4105 Target:  5'-AAGCTACCAGTAAAGTGGATGGCTTTA-3'    (SEQ ID NO: 2709)

5'-CUUUGGUGUGCUCCUCUGGGAGCUC C C-3'   (SEQ ID NO: 2926)
                   3'-GAAACCACACGAGGAGACCCUCGAG U A-5'   (SEQ ID NO: 2638)

MET-m4179 Target:  5'-CTTTGGTGTGCTCCTCTGGGAGCTCAT-3'    (SEQ ID NO: 2710)

5'-UUUGGUGUGCUCCUCUGGGAGCUCA C A-3'   (SEQ ID NO: 2927)
                   3'-AAACCACACGAGGAGACCCUCGAGU A C-5'   (SEQ ID NO: 2639)

MET-m4180 Target:  5'-TTTGGTGTGCTCCTCTGGGAGCTCATG-3'    (SEQ ID NO: 2711)

5'-UGGUGUGCUCCUCUGGGAGCUCAUG C A-3'   (SEQ ID NO: 2928)
                   3'-ACCACACGAGGAGACCCUCGAGUAC U G-5'   (SEQ ID NO: 2640)

MET-m4182 Target:  5'-TGGTGTGCTCCTCTGGGAGCTCATGAC-3'    (SEQ ID NO: 2712)

5'-UUUUGUUUUGUUUUUUGUUUUGCUU C C-3'   (SEQ ID NO: 2929)
                   3'-AAAACAAAACAAAAAACAAAACGAA A A-5'   (SEQ ID NO: 2641)

MET-m4639 Target:  5'-TTTTGTTTTGTTTTTGTTTTGCTTTT-3'     (SEQ ID NO: 2713)

5'-UUUGUUUUGUUUUUUGUUUUGCUUU C A-3'   (SEQ ID NO: 2930)
                   3'-AAACAAAACAAAAAACAAAACGAAA A C-5'   (SEQ ID NO: 2642)

MET-m4640 Target:  5'-TTTGTTTTGTTTTTGTTTTGCTTTTG-3'     (SEQ ID NO: 2714)

5'-UUGUUUUGUUUUUUGUUUUGCUUUU A A-3'   (SEQ ID NO: 2931)
                   3'-AACAAAACAAAAAACAAAACGAAAA C G-5'   (SEQ ID NO: 2643)

MET-m4641 Target:  5'-TTGTTTTGTTTTTGTTTTGCTTTTGC-3'     (SEQ ID NO: 2715)

5'-UGUUUUGUUUUUUGUUUUGCUUUUG A A-3'   (SEQ ID NO: 2932)
                   3'-ACAAAACAAAAAACAAAACGAAAAC G C-5'   (SEQ ID NO: 2644)

MET-m4642 Target:  5'-TGTTTTGTTTTTGTTTTGCTTTTGCG-3'     (SEQ ID NO: 2716)

5'-GUUUUGUUUUUUGUUUUGCUUUUGC A A-3'   (SEQ ID NO: 2933)
                   3'-CAAAACAAAAAACAAAACGAAAACG C C-5'   (SEQ ID NO: 2645)

MET-m4643 Target:  5'-GTTTTGTTTTTGTTTTGCTTTTGCGG-3'     (SEQ ID NO: 2717)

5'-UUUGUUUUUUGUUUUGCUUUUGCGG C C-3'   (SEQ ID NO: 2934)
                   3'-AAACAAAAAACAAAACGAAAACGCC A U-5'   (SEQ ID NO: 2646)

MET-m4645 Target:  5'-TTTGTTTTTGTTTTGCTTTTGCGGTA-3'     (SEQ ID NO: 2718)

5'-UUGUUUUUUGUUUUGCUUUUGCGGU C C-3'   (SEQ ID NO: 2935)
                   3'-AACAAAAAACAAAACGAAAACGCCA U U-5'   (SEQ ID NO: 2647)

MET-m4646 Target:  5'-TTGTTTTTGTTTTGCTTTTGCGGTAA-3'     (SEQ ID NO: 2719)

5'-UGUUUUUUGUUUUGCUUUUGCGGUA C A-3'   (SEQ ID NO: 2936)
                   3'-ACAAAAAACAAAACGAAAACGCCAU U G-5'   (SEQ ID NO: 2648)

MET-m4647 Target:  5'-TGTTTTTGTTTTGCTTTTGCGGTAAC-3'     (SEQ ID NO: 2720)

5'-GUUUUUUGUUUUGCUUUUGCGGUAA A C-3'   (SEQ ID NO: 2937)
                   3'-CAAAAAACAAAACGAAAACGCCAUU G A-5'   (SEQ ID NO: 2649)

MET-m4648 Target:  5'-GTTTTTGTTTTGCTTTTGCGGTAACT-3'     (SEQ ID NO: 2721)
```

TABLE 8-continued

Selected Mouse Anti-MET "Blunt/Fray" DsiRNAs

```
                  5'-UUUUUUGUUUUGCUUUUGCGGUAAC C A-3'   (SEQ ID NO: 2938)
                  3'-AAAAAACAAAACGAAAACGCCAUUG A C-5'   (SEQ ID NO: 2650)

MET-m4649 Target: 5'-TTTTTTGTTTTGCTTTTGCGGTAACTG-3'    (SEQ ID NO: 2722)

5'-UUUUGUUUUGCUUUUGCGGUAACU A A-3'   (SEQ ID NO: 2939)
                  3'-AAAAACAAAACGAAAACGCCAUUGA C G-5'  (SEQ ID NO: 2651)

MET-m4650 Target: 5'-TTTTTGTTTTGCTTTTGCGGTAACTGC-3'    (SEQ ID NO: 2723)

5'-UUUUGUUUUGCUUUUGCGGUAACUG A C-3'  (SEQ ID NO: 2940)
                  3'-AAAACAAAACGAAAACGCCAUUGAC G U-5'  (SEQ ID NO: 2652)

MET-m4651 Target: 5'-TTTTGTTTTGCTTTTGCGGTAACTGCA-3'    (SEQ ID NO: 2724)

5'-UUUGUUUUGCUUUUGCGGUAACUGC C A-3'  (SEQ ID NO: 2941)
                  3'-AAACAAAACGAAAACGCCAUUGACG U G-5'  (SEQ ID NO: 2653)

ET-m4652 Target:  M5'-TTTGTTTTGCTTTTGCGGTAACTGCAC-3'   (SEQ ID NO: 2725)

5'-UUGUUUUGCUUUUGCGGUAACUGCA A A-3'  (SEQ ID NO: 2942)
                  3'-AACAAAACGAAAACGCCAUUGACGU G G-5'  (SEQ ID NO: 2654)

MET-m4653 Target: 5'-TTGTTTTGCTTTTGCGGTAACTGCACC-3'    (SEQ ID NO: 2726)

5'-UGUUUUGCUUUUGCGGUAACUGCAC A C-3'  (SEQ ID NO: 2943)
                  3'-ACAAAACGAAAACGCCAUUGACGUG G U-5'  (SEQ ID NO: 2655)

MET-m4654 Target: 5'-TGTTTTGCTTTTGCGGTAACTGCACCA-3'    (SEQ ID NO: 2727)

5'-GUUUUGCUUUUGCGGUAACUGCACC C A-3'  (SEQ ID NO: 2944)
                  3'-CAAAACGAAAACGCCAUUGACGUGG U G-5'  (SEQ ID NO: 2656)

MET-m4655 Target: 5'-GTTTTGCTTTTGCGGTAACTGCACCAC-3'    (SEQ ID NO: 2728)

5'-UUUUGCUUUUGCGGUAACUGCACCA A C-3'  (SEQ ID NO: 2945)
                  3'-AAAACGAAAACGCCAUUGACGUGGU G A-5'  (SEQ ID NO: 2657)

MET-m4656 Target: 5'-TTTTGCTTTTGCGGTAACTGCACCACT-3'    (SEQ ID NO: 2729)

5'-UGCUUUUGCGGUAACUGCACCACUA C A-3'  (SEQ ID NO: 2946)
                  3'-ACGAAAACGCCAUUGACGUGGUGAU A C-5'  (SEQ ID NO: 2658)

MET-m4659 Target: 5'-TGCTTTTGCGGTAACTGCACCACTATG-3'    (SEQ ID NO: 2730)

5'-AACCCAGCUGUUUAGCAAGGAGUGU C A-3'  (SEQ ID NO: 2947)
                  3'-UUGGGUCGACAAAUCGUUCCUCACA A C-5'  (SEQ ID NO: 2659)

MET-m5255 Target: 5'-AACCCAGCTGTTTAGCAAGGAGTGTTG-3'    (SEQ ID NO: 2731)

5'-CAGCUGUUUAGCAAGGAGUGUUGGC C A-3'  (SEQ ID NO: 2948)
                  3'-GUCGACAAAUCGUUCCUCACAACCG A G-5'  (SEQ ID NO: 2660)

MET-m5259 Target: 5'-CAGCTGTTTAGCAAGGAGTGTTGGCTC-3'    (SEQ ID NO: 2732)

5'-UUUUGUGCUUACUACUGUAUAGUGC C C-3'  (SEQ ID NO: 2949)
                  3'-AAAACACGAAUGAUGACAUAUCACG U A-5'  (SEQ ID NO: 2661)

MET-m5835 Target: 5'-TTTTGTGCTTACTACTGTATAGTGCAT-3'    (SEQ ID NO: 2733)

5'-UUUGUGCUUACUACUGUAUAGUGCA C A-3'  (SEQ ID NO: 2950)
                  3'-AAACACGAAUGAUGACAUAUCACGU A C-5'  (SEQ ID NO: 2662)

MET-m5836 Target: 5'-TTTGTGCTTACTACTGTATAGTGCATG-3'    (SEQ ID NO: 2734)
```

TABLE 8-continued

Selected Mouse Anti-MET "Blunt/Fray" DsiRNAs

```
                5'-UUGUGCUUACUACUGUAUAGUGCAU A C-3'   (SEQ ID NO: 2951)
                3'-AACACGAAUGAUGACAUAUCACGUA C A-5'   (SEQ ID NO: 2663)

MET-m5837 Target: 5'-TTGTGCTTACTACTGTATAGTGCATGT-3'  (SEQ ID NO: 2735)

5'-GUGCUUACUACUGUAUAGUGCAUGU A A-3'   (SEQ ID NO: 2952)
                3'-CACGAAUGAUGACAUAUCACGUACA C C-5'   (SEQ ID NO: 2664)

MET-m5839 Target: 5'-GTGCTTACTACTGTATAGTGCATGTGG-3'  (SEQ ID NO: 2736)
```

TABLE 9

Selected Human Anti-MET "Blunt/Blunt" DsiRNAs

```
                 5'-GGCGCGGAGCGCGCGUGUGGUCCUUGC-3'   (SEQ ID NO: 2161)
                 3'-CCGCGCCUCGCGCGCACACCAGGAACG-5'   (SEQ ID NO: 361)
MET-136 Target:  5'-GGCGCGGAGCGCGCGTGTGGTCCTTGC-3'   (SEQ ID NO: 721)

5'-GCGCGGAGCGCGCGUGUGGUCCUUGCG-3'   (SEQ ID NO: 2162)
                 3'-CGCGCCUCGCGCGCACACCAGGAACGC-5'   (SEQ ID NO: 362)
MET-137 Target:  5'-GCGCGGAGCGCGCGTGTGGTCCTTGCG-3'   (SEQ ID NO: 722)

5'-CGCGGAGCGCGCGUGUGGUCCUUGCGC-3'   (SEQ ID NO: 2163)
                 3'-GCGCCUCGCGCGCACACCAGGAACGCG-5'   (SEQ ID NO: 363)
MET-138 Target:  5'-CGCGGAGCGCGCGTGTGGTCCTTGCGC-3'   (SEQ ID NO: 723)

5'-CGGAGCGCGCGUGUGGUCCUUGCGCCG-3'   (SEQ ID NO: 2164)
                 3'-GCCUCGCGCGCACACCAGGAACGCGGC-5'   (SEQ ID NO: 364)
MET-140 Target:  5'-CGGAGCGCGCGTGTGGTCCTTGCGCCG-3'   (SEQ ID NO: 724)

5'-GAGCGCGCGUGUGGUCCUUGCGCCGCU-3'   (SEQ ID NO: 2165)
                 3'-CUCGCGCGCACACCAGGAACGCGGCGA-5'   (SEQ ID NO: 365)
MET-142 Target:  5'-GAGCGCGCGTGTGGTCCTTGCGCCGCT-3'   (SEQ ID NO: 725)

5'-AGCGCGCGUGUGGUCCUUGCGCCGCUG-3'   (SEQ ID NO: 2166)
                 3'-UCGCGCGCACACCAGGAACGCGGCGAC-5'   (SEQ ID NO: 366)
MET-143 Target:  5'-AGCGCGCGTGTGGTCCTTGCGCCGCTG-3'   (SEQ ID NO: 726)

5'-CGCGCGUGUGGUCCUUGCGCCGCUGAC-3'   (SEQ ID NO: 2167)
                 3'-GCGCGCACACCAGGAACGCGGCGACUG-5'   (SEQ ID NO: 367)
MET-145 Target:  5'-CGCGCGTGTGGTCCTTGCGCCGCTGAC-3'   (SEQ ID NO: 727)

5'-GCGCGUGUGGUCCUUGCGCCGCUGACU-3'   (SEQ ID NO: 2168)
                 3'-CGCGCACACCAGGAACGCGGCGACUGA-5'   (SEQ ID NO: 368)
MET-146 Target:  5'-GCGCGTGTGGTCCTTGCGCCGCTGACT-3'   (SEQ ID NO: 728)

5'-GCGUGUGGUCCUUGCGCCGCUGACUUC-3'   (SEQ ID NO: 2169)
                 3'-CGCACACCAGGAACGCGGCGACUGAAG-5'   (SEQ ID NO: 369)
MET-148 Target:  5'-GCGTGTGGTCCTTGCGCCGCTGACTTC-3'   (SEQ ID NO: 729)

5'-GUCCUUGCGCCGCUGACUUCUCCACUG-3'   (SEQ ID NO: 2170)
                 3'-CAGGAACGCGGCGACUGAAGAGGUGAC-5'   (SEQ ID NO: 370)
MET-155 Target:  5'-GTCCTTGCGCCGCTGACTTCTCCACTG-3'   (SEQ ID NO: 730)

5'-UUGCGCCGCUGACUUCUCCACUGGUUC-3'   (SEQ ID NO: 2171)
                 3'-AACGCGGCGACUGAAGAGGUGACCAAG-5'   (SEQ ID NO: 371)
MET-159 Target:  5'-TTGCGCCGCTGACTTCTCCACTGGTTC-3'   (SEQ ID NO: 731)

5'-CGCUGUGCUUGCACCUGGCAUCCUCGU-3'   (SEQ ID NO: 2172)
                 3'-GCGACACGAACGUGGACCGUAGGAGCA-5'   (SEQ ID NO: 372)
MET-225 Target:  5'-CGCTGTGCTTGCACCTGGCATCCTCGT-3'   (SEQ ID NO: 732)

5'-CUGUGCUUGCACCUGGCAUCCUCGUGC-3'   (SEQ ID NO: 2173)
                 3'-GACACGAACGUGGACCGUAGGAGCACG-5'   (SEQ ID NO: 373)
MET-227 Target:  5'-CTGTGCTTGCACCTGGCATCCTCGTGC-3'   (SEQ ID NO: 733)

5'-UGCACCUGGCAUCCUCGUGCUCCUGUU-3'   (SEQ ID NO: 2174)
                 3'-ACGUGGACCGUAGGAGCACGAGGACAA-5'   (SEQ ID NO: 374)
MET-234 Target:  5'-TGCACCTGGCATCCTCGTGCTCCTGTT-3'   (SEQ ID NO: 734)

5'-UCCUCGUGCUCCUGUUUACCUUGGUGC-3'   (SEQ ID NO: 2175)
                 3'-AGGAGCACGAGGACAAAUGGAACCACG-5'   (SEQ ID NO: 375)
MET-245 Target:  5'-TCCTCGTGCTCCTGTTTACCTTGGTGC-3'   (SEQ ID NO: 735)
```

TABLE 9-continued

Selected Human Anti-MET "Blunt/Blunt" DsiRNAs

|  |  |  |
|---|---|---|
| MET-248 Target: | 5'-UCGUGCUCCUGUUUACCUUGGUGCAGA-3'<br>3'-AGCACGAGGACAAAUGGAACCACGUCU-5'<br>5'-TCGTGCTCCTGTTTACCTTGGTGCAGA-3' | (SEQ ID NO: 2176)<br>(SEQ ID NO: 376)<br>(SEQ ID NO: 736) |
| MET-249 Target: | 5'-CGUGCUCCUGUUUACCUUGGUGCAGAG-3'<br>3'-GCACGAGGACAAAUGGAACCACGUCUC-5'<br>5'-CGTGCTCCTGTTTACCTTGGTGCAGAG-3' | (SEQ ID NO: 2177)<br>(SEQ ID NO: 377)<br>(SEQ ID NO: 737) |
| MET-409 Target: | 5'-GCCACUAACUACAUUUAUGUUUUAAAU-3'<br>3'-CGGUGAUUGAUGUAAAUACAAAAUUUA-5'<br>5'-GCCACTAACTACATTTATGTTTTAAAT-3' | (SEQ ID NO: 2178)<br>(SEQ ID NO: 378)<br>(SEQ ID NO: 738) |
| MET-413 Target: | 5'-CUAACUACAUUUAUGUUUUAAAUGAGG-3'<br>3'-GAUUGAUGUAAAUACAAAAUUUACUCC-5'<br>5'-CTAACTACATTTATGTTTTAAATGAGG-3' | (SEQ ID NO: 2179)<br>(SEQ ID NO: 379)<br>(SEQ ID NO: 739) |
| MET-414 Target: | 5'-UAACUACAUUUAUGUUUUAAAUGAGGA-3'<br>3'-AUUGAUGUAAAUACAAAAUUUACUCCU-5'<br>5'-TAACTACATTTATGTTTTAAATGAGGA-3' | (SEQ ID NO: 2180)<br>(SEQ ID NO: 380)<br>(SEQ ID NO: 740) |
| MET-415 Target: | 5'-AACUACAUUUAUGUUUUAAAUGAGGAA-3'<br>3'-UUGAUGUAAAUACAAAAUUUACUCCUU-5'<br>5'-AACTACATTTATGTTTTAAATGAGGAA-3' | (SEQ ID NO: 2181)<br>(SEQ ID NO: 381)<br>(SEQ ID NO: 741) |
| MET-416 Target: | 5'-ACUACAUUUAUGUUUUAAAUGAGGAAG-3'<br>3'-UGAUGUAAAUACAAAAUUUACUCCUUC-5'<br>5'-ACTACATTTATGTTTTAAATGAGGAAG-3' | (SEQ ID NO: 2182)<br>(SEQ ID NO: 382)<br>(SEQ ID NO: 742) |
| MET-417 Target: | 5'-CUACAUUUAUGUUUUAAAUGAGGAAGA-3'<br>3'-GAUGUAAAUACAAAAUUUACUCCUUCU-5'<br>5'-CTACATTTATGTTTTAAATGAGGAAGA-3' | (SEQ ID NO: 2183)<br>(SEQ ID NO: 383)<br>(SEQ ID NO: 743) |
| MET-480 Target: | 5'-GCUGGAACACCCAGAUUGUUUCCCAUG-3'<br>3'-CGACCUUGUGGGUCUAACAAAGGGUAC-5'<br>5'-GCTGGAACACCCAGATTGTTTCCCATG-3' | (SEQ ID NO: 2184)<br>(SEQ ID NO: 384)<br>(SEQ ID NO: 744) |
| MET-508 Target: | 5'-CAGGACUGCAGCAGCAAAGCCAAUUUA-3'<br>3'-GUCCUGACGUCGUCGUUUCGGUUAAAU-5'<br>5'-CAGGACTGCAGCAGCAAAGCCAATTTA-3' | (SEQ ID NO: 2185)<br>(SEQ ID NO: 385)<br>(SEQ ID NO: 745) |
| MET-509 Target: | 5'-AGGACUGCAGCAGCAAAGCCAAUUUAU-3'<br>3'-UCCUGACGUCGUCGUUUCGGUUAAAUA-5'<br>5'-AGGACTGCAGCAGCAAAGCCAATTTAT-3' | (SEQ ID NO: 2186)<br>(SEQ ID NO: 386)<br>(SEQ ID NO: 746) |
| MET-510 Target: | 5'-GGACUGCAGCAGCAAAGCCAAUUUAUC-3'<br>3'-CCUGACGUCGUCGUUUCGGUUAAAUAG-5'<br>5'-GGACTGCAGCAGCAAAGCCAATTTATC-3' | (SEQ ID NO: 2187)<br>(SEQ ID NO: 387)<br>(SEQ ID NO: 747) |
| MET-511 Target: | 5'-GACUGCAGCAGCAAAGCCAAUUUAUCA-3'<br>3'-CUGACGUCGUCGUUUCGGUUAAAUAGU-5'<br>5'-GACTGCAGCAGCAAAGCCAATTTATCA-3' | (SEQ ID NO: 2188)<br>(SEQ ID NO: 388)<br>(SEQ ID NO: 748) |
| MET-512 Target: | 5'-ACUGCAGCAGCAAAGCCAAUUUAUCAG-3'<br>3'-UGACGUCGUCGUUUCGGUUAAAUAGUC-5'<br>5'-ACTGCAGCAGCAAAGCCAATTTATCAG-3' | (SEQ ID NO: 2189)<br>(SEQ ID NO: 389)<br>(SEQ ID NO: 749) |
| MET-584 Target: | 5'-CCUACUAUGAUGAUCAACUCAUUAGCU-3'<br>3'-GGAUGAUACUACUAGUUGAGUAAUCGA-5'<br>5'-CCTACTATGATGATCAACTCATTAGCT-3' | (SEQ ID NO: 2190)<br>(SEQ ID NO: 390)<br>(SEQ ID NO: 750) |
| MET-585 Target: | 5'-CUACUAUGAUGAUCAACUCAUUAGCUG-3'<br>3'-GAUGAUACUACUAGUUGAGUAAUCGAC-5'<br>5'-CTACTATGATGATCAACTCATTAGCTG-3' | (SEQ ID NO: 2191)<br>(SEQ ID NO: 391)<br>(SEQ ID NO: 751) |
| MET-586 Target: | 5'-UACUAUGAUGAUCAACUCAUUAGCUGU-3'<br>3'-AUGAUACUACUAGUUGAGUAAUCGACA-5'<br>5'-TACTATGATGATCAACTCATTAGCTGT-3' | (SEQ ID NO: 2192)<br>(SEQ ID NO: 392)<br>(SEQ ID NO: 752) |
| MET-587 Target: | 5'-ACUAUGAUGAUCAACUCAUUAGCUGUG-3'<br>3'-UGAUACUACUAGUUGAGUAAUCGACAC-5'<br>5'-ACTATGATGATCAACTCATTAGCTGTG-3' | (SEQ ID NO: 2193)<br>(SEQ ID NO: 393)<br>(SEQ ID NO: 753) |
| MET-588 Target: | 5'-CUAUGAUGAUCAACUCAUUAGCUGUGG-3'<br>3'-GAUACUACUAGUUGAGUAAUCGACACC-5'<br>5'-CTATGATGATCAACTCATTAGCTGTGG-3' | (SEQ ID NO: 2194)<br>(SEQ ID NO: 394)<br>(SEQ ID NO: 754) |

TABLE 9-continued

Selected Human Anti-MET "Blunt/Blunt" DsiRNAs

```
              5'-UAUGAUGAUCAACUCAUUAGCUGUGGC-3'    (SEQ ID NO: 2195)
              3'-AUACUACUAGUUGAGUAAUCGACACCG-5'    (SEQ ID NO: 395)
MET-589 Target: 5'-TATGATGATCAACTCATTAGCTGTGGC-3'  (SEQ ID NO: 755)

5'-AUGAUGAUCAACUCAUUAGCUGUGGCA-3'   (SEQ ID NO: 2196)
              3'-UACUACUAGUUGAGUAAUCGACACCGU-5'   (SEQ ID NO: 396)
MET-590 Target: 5'-ATGATGATCAACTCATTAGCTGTGGCA-3' (SEQ ID NO: 756)

5'-UGAUGAUCAACUCAUUAGCUGUGGCAG-3'   (SEQ ID NO: 2197)
              3'-ACUACUAGUUGAGUAAUCGACACCGUC-5'   (SEQ ID NO: 397)
MET-591 Target: 5'-TGATGATCAACTCATTAGCTGTGGCAG-3' (SEQ ID NO: 757)

5'-GAUGAUCAACUCAUUAGCUGUGGCAGC-3'   (SEQ ID NO: 2198)
              3'-CUACUAGUUGAGUAAUCGACACCGUCG-5'   (SEQ ID NO: 398)
MET-592 Target: 5'-GATGATCAACTCATTAGCTGTGGCAGC-3' (SEQ ID NO: 758)

5'-AUGAUCAACUCAUUAGCUGUGGCAGCG-3'   (SEQ ID NO: 2199)
              3'-UACUAGUUGAGUAAUCGACACCGUCGC-5'   (SEQ ID NO: 399)
MET-593 Target: 5'-ATGATCAACTCATTAGCTGTGGCAGCG-3' (SEQ ID NO: 759)

5'-UGAUCAACUCAUUAGCUGUGGCAGCGU-3'   (SEQ ID NO: 2200)
              3'-ACUAGUUGAGUAAUCGACACCGUCGCA-5'   (SEQ ID NO: 400)
MET-594 Target: 5'-TGATCAACTCATTAGCTGTGGCAGCGT-3' (SEQ ID NO: 760)

5'-GAUCAACUCAUUAGCUGUGGCAGCGUC-3'   (SEQ ID NO: 2201)
              3'-CUAGUUGAGUAAUCGACACCGUCGCAG-5'   (SEQ ID NO: 401)
MET-595 Target: 5'-GATCAACTCATTAGCTGTGGCAGCGTC-3' (SEQ ID NO: 761)

5'-AUCAACUCAUUAGCUGUGGCAGCGUCA-3'   (SEQ ID NO: 2202)
              3'-UAGUUGAGUAAUCGACACCGUCGCAGU-5'   (SEQ ID NO: 402)
MET-596 Target: 5'-ATCAACTCATTAGCTGTGGCAGCGTCA-3' (SEQ ID NO: 762)

5'-UCAACUCAUUAGCUGUGGCAGCGUCAA-3'   (SEQ ID NO: 2203)
              3'-AGUUGAGUAAUCGACACCGUCGCAGUU-5'   (SEQ ID NO: 403)
MET-597 Target: 5'-TCAACTCATTAGCTGTGGCAGCGTCAA-3' (SEQ ID NO: 763)

5'-AAGAUGGUUUUAUGUUUUUGACGGACC-3'   (SEQ ID NO: 2204)
              3'-UUCUACCAAAAUACAAAAACUGCCUGG-5'   (SEQ ID NO: 404)
MET-881 Target: 5'-AAGATGGTTTTATGTTTTTGACGGACC-3' (SEQ ID NO: 764)

5'-GCCUUUGAAAGCAACAAUUUUAUUUAC-3'   (SEQ ID NO: 2205)
              3'-CGGAAACUUUCGUUGUUAAAAUAAAUG-5'   (SEQ ID NO: 405)
MET-967 Target: 5'-GCCTTTGAAAGCAACAATTTTATTTAC-3' (SEQ ID NO: 765)

5'-AGGGAAACUCUAGAUGCUCAGACUUUU-3'   (SEQ ID NO: 2206)
              3'-UCCCUUUGAGAUCUACGAGUCUGAAAA-5'   (SEQ ID NO: 406)
MET-1009 Target: 5'-AGGGAAACTCTAGATGCTCAGACTTTT-3' (SEQ ID NO: 766)

5'-GGGAAACUCUAGAUGCUCAGACUUUUC-3'   (SEQ ID NO: 2207)
              3'-CCCUUUGAGAUCUACGAGUCUGAAAAG-5'   (SEQ ID NO: 407)
MET-1010 Target: 5'-GGGAAACTCTAGATGCTCAGACTTTTC-3' (SEQ ID NO: 767)

5'-GGAAACUCUAGAUGCUCAGACUUUUCA-3'   (SEQ ID NO: 2208)
              3'-CCUUUGAGAUCUACGAGUCUGAAAAGU-5'   (SEQ ID NO: 408)
MET-1011 Target: 5'-GGAAACTCTAGATGCTCAGACTTTTCA-3' (SEQ ID NO: 768)

5'-GAAACUCUAGAUGCUCAGACUUUUCAC-3'   (SEQ ID NO: 2209)
              3'-CUUUGAGAUCUACGAGUCUGAAAAGUG-5'   (SEQ ID NO: 409)
MET-1012 Target: 5'-GAAACTCTAGATGCTCAGACTTTTCAC-3' (SEQ ID NO: 769)

5'-AAACUCUAGAUGCUCAGACUUUUCACA-3'   (SEQ ID NO: 2210)
              3'-UUUGAGAUCUACGAGUCUGAAAAGUGU-5'   (SEQ ID NO: 410)
MET-1013 Target: 5'-AAACTCTAGATGCTCAGACTTTTCACA-3' (SEQ ID NO: 770)

5'-AACUCUAGAUGCUCAGACUUUUCACAC-3'   (SEQ ID NO: 2211)
              3'-UUGAGAUCUACGAGUCUGAAAAGUGUG-5'   (SEQ ID NO: 411)
MET-1014 Target: 5'-AACTCTAGATGCTCAGACTTTTCACAC-3' (SEQ ID NO: 771)

5'-CACACAAGAAUAAUCAGGUUCUGUUCC-3'   (SEQ ID NO: 2212)
              3'-GUGUGUUCUUAUUAGUCCAAGACAAGG-5'   (SEQ ID NO: 412)
MET-1036 Target: 5'-CACACAAGAATAATCAGGTTCTGTTCC-3' (SEQ ID NO: 772)

5'-CACAAGAAUAAUCAGGUUCUGUUCCAU-3'   (SEQ ID NO: 2213)
              3'-GUGUUCUUAUUAGUCCAAGACAAGGUA-5'   (SEQ ID NO: 413)
MET-1038 Target: 5'-CACAAGAATAATCAGGTTCTGTTCCAT-3' (SEQ ID NO: 773)
```

TABLE 9-continued

Selected Human Anti-MET "Blunt/Blunt" DsiRNAs

```
              5'-ACAAGAAUAAUCAGGUUCUGUUCCAUA-3'     (SEQ ID NO: 2214)
              3'-UGUUCUUAUUAGUCCAAGACAAGGUAU-5'     (SEQ ID NO: 414)
MET-1039 Target: 5'-ACAAGAATAATCAGGTTCTGTTCCATA-3'  (SEQ ID NO: 774)

5'-CAAGAAUAAUCAGGUUCUGUUCCAUAA-3'    (SEQ ID NO: 2215)
              3'-GUUCUUAUUAGUCCAAGACAAGGUAUU-5'    (SEQ ID NO: 415)
MET-1040 Target: 5'-CAAGAATAATCAGGTTCTGTTCCATAA-3' (SEQ ID NO: 775)

5'-AAGAAUAAUCAGGUUCUGUUCCAUAAA-3'    (SEQ ID NO: 2216)
              3'-UUCUUAUUAGUCCAAGACAAGGUAUUU-5'    (SEQ ID NO: 416)
MET-1041 Target: 5'-AAGAATAATCAGGTTCTGTTCCATAAA-3' (SEQ ID NO: 776)

5'-AGAAUAAUCAGGUUCUGUUCCAUAAAC-3'    (SEQ ID NO: 2217)
              3'-UCUUAUUAGUCCAAGACAAGGUAUUUG-5'    (SEQ ID NO: 417)
MET-1042 Target: 5'-AGAATAATCAGGTTCTGTTCCATAAAC-3' (SEQ ID NO: 777)

5'-CUGUUCCAUAAACUCUGGAUUGCAUUC-3'    (SEQ ID NO: 2218)
              3'-GACAAGGUAUUUGAGACCUAACGUAAG-5'    (SEQ ID NO: 418)
MET-1056 Target: 5'-CTGTTCCATAAACTCTGGATTGCATTC-3' (SEQ ID NO: 778)

5'-CUGGAGUGUAUUCUCACAGAAAAGAGA-3'    (SEQ ID NO: 2219)
              3'-GACCUCACAUAAGAGUGUCUUUUCUCU-5'    (SEQ ID NO: 419)
MET-1099 Target: 5'-CTGGAGTGTATTCTCACAGAAAAGAGA-3' (SEQ ID NO: 779)

5'-AAGGAAGUGUUUAAUAUACUUCAGGCU-3'    (SEQ ID NO: 2220)
              3'-UUCCUUCACAAAUUAUAUGAAGUCCGA-5'    (SEQ ID NO: 420)
MET-1144 Target: 5'-AAGGAAGTGTTTAATATACTTCAGGCT-3' (SEQ ID NO: 780)

5'-UUCAGGCUGCGUAUGUCAGCAAGCCUG-3'    (SEQ ID NO: 2221)
              3'-AAGUCCGACGCAUACAGUCGUUCGGAC-5'    (SEQ ID NO: 421)
MET-1163 Target: 5'-TTCAGGCTGCGTATGTCAGCAAGCCTG-3' (SEQ ID NO: 781)

5'-UCGCACAAAGCAAGCCAGAUUCUGCCG-3'    (SEQ ID NO: 2222)
              3'-AGCGUGUUUCGUUCGGUCUAAGACGGC-5'    (SEQ ID NO: 422)
MET-1250 Target: 5'-TCGCACAAAGCAAGCCAGATTCTGCCG-3' (SEQ ID NO: 782)

5'-CGCACAAAGCAAGCCAGAUUCUGCCGA-3'    (SEQ ID NO: 2223)
              3'-GCGUGUUUCGUUCGGUCUAAGACGGCU-5'    (SEQ ID NO: 423)
MET-1251 Target: 5'-CGCACAAAGCAAGCCAGATTCTGCCGA-3' (SEQ ID NO: 783)

5'-GCACAAAGCAAGCCAGAUUCUGCCGAA-3'    (SEQ ID NO: 2224)
              3'-CGUGUUUCGUUCGGUCUAAGACGGCUU-5'    (SEQ ID NO: 424)
MET-1252 Target: 5'-GCACAAAGCAAGCCAGATTCTGCCGAA-3' (SEQ ID NO: 784)

5'-CACAAAGCAAGCCAGAUUCUGCCGAAC-3'    (SEQ ID NO: 2225)
              3'-GUGUUUCGUUCGGUCUAAGACGGCUUG-5'    (SEQ ID NO: 425)
MET-1253 Target: 5'-CACAAAGCAAGCCAGATTCTGCCGAAC-3' (SEQ ID NO: 785)

5'-ACAAAGCAAGCCAGAUUCUGCCGAACC-3'    (SEQ ID NO: 2226)
              3'-UGUUUCGUUCGGUCUAAGACGGCUUGG-5'    (SEQ ID NO: 426)
MET-1254 Target: 5'-ACAAAGCAAGCCAGATTCTGCCGAACC-3' (SEQ ID NO: 786)

5'-AUGUGAGAUGUCUCCAGCAUUUUUACG-3'    (SEQ ID NO: 2227)
              3'-UACACUCUACAGAGGUCGUAAAAAUGC-5'    (SEQ ID NO: 427)
MET-1358 Target: 5'-ATGTGAGATGTCTCCAGCATTTTTACG-3' (SEQ ID NO: 787)

5'-UGUGAGAUGUCUCCAGCAUUUUUACGG-3'    (SEQ ID NO: 2228)
              3'-ACACUCUACAGAGGUCGUAAAAAUGCC-5'    (SEQ ID NO: 428)
MET-1359 Target: 5'-TGTGAGATGTCTCCAGCATTTTTACGG-3' (SEQ ID NO: 788)

5'-GUGAGAUGUCUCCAGCAUUUUUACGGA-3'    (SEQ ID NO: 2229)
              3'-CACUCUACAGAGGUCGUAAAAAUGCCU-5'    (SEQ ID NO: 429)
MET-1360 Target: 5'-GTGAGATGTCTCCAGCATTTTTACGGA-3' (SEQ ID NO: 789)

5'-UGAGAUGUCUCCAGCAUUUUUACGGAC-3'    (SEQ ID NO: 2230)
              3'-ACUCUACAGAGGUCGUAAAAAUGCCUG-5'    (SEQ ID NO: 430)
MET-1361 Target: 5'-TGAGATGTCTCCAGCATTTTTACGGAC-3' (SEQ ID NO: 790)

5'-GAGAUGUCUCCAGCAUUUUUACGGACC-3'    (SEQ ID NO: 2231)
              3'-CUCUACAGAGGUCGUAAAAAUGCCUGG-5'    (SEQ ID NO: 431)
MET-1362 Target: 5'-GAGATGTCTCCAGCATTTTTACGGACC-3' (SEQ ID NO: 791)

5'-AGAUGUCUCCAGCAUUUUUACGGACCC-3'    (SEQ ID NO: 2232)
              3'-UCUACAGAGGUCGUAAAAAUGCCUGGG-5'    (SEQ ID NO: 432)
MET-1363 Target: 5'-AGATGTCTCCAGCATTTTTACGGACCC-3' (SEQ ID NO: 792)
```

TABLE 9-continued

Selected Human Anti-MET "Blunt/Blunt" DsiRNAs

```
                 5'-GAUGUCUCCAGCAUUUUUACGGACCCA-3'    (SEQ ID NO: 2233)
                 3'-CUACAGAGGUCGUAAAAAUGCCUGGGU-5'    (SEQ ID NO: 433)
MET-1364 Target: 5'-GATGTCTCCAGCATTTTTACGGACCCA-3'    (SEQ ID NO: 793)

5'-AUGUCUCCAGCAUUUUUACGGACCCAA-3'    (SEQ ID NO: 2234)
                 3'-UACAGAGGUCGUAAAAAUGCCUGGGUU-5'    (SEQ ID NO: 434)
MET-1365 Target: 5'-ATGTCTCCAGCATTTTTACGGACCCAA-3'    (SEQ ID NO: 794)

5'-UGUCUCCAGCAUUUUUACGGACCCAAU-3'    (SEQ ID NO: 2235)
                 3'-ACAGAGGUCGUAAAAAUGCCUGGGUUA-5'    (SEQ ID NO: 435)
MET-1366 Target: 5'-TGTCTCCAGCATTTTTACGGACCCAAT-3'    (SEQ ID NO: 795)

5'-GUCUCCAGCAUUUUUACGGACCCAAUC-3'    (SEQ ID NO: 2236)
                 3'-CAGAGGUCGUAAAAAUGCCUGGGUUAG-5'    (SEQ ID NO: 436)
MET-1367 Target: 5'-GTCTCCAGCATTTTTACGGACCCAATC-3'    (SEQ ID NO: 796)

5'-UCUCCAGCAUUUUUACGGACCCAAUCA-3'    (SEQ ID NO: 2237)
                 3'-AGAGGUCGUAAAAAUGCCUGGGUUAGU-5'    (SEQ ID NO: 437)
MET-1368 Target: 5'-TCTCCAGCATTTTTACGGACCCAATCA-3'    (SEQ ID NO: 797)

5'-CUCCAGCAUUUUUACGGACCCAAUCAU-3'    (SEQ ID NO: 2238)
                 3'-GAGGUCGUAAAAAUGCCUGGGUUAGUA-5'    (SEQ ID NO: 438)
MET-1369 Target: 5'-CTCCAGCATTTTTACGGACCCAATCAT-3'    (SEQ ID NO: 798)

5'-UCCAGCAUUUUUACGGACCCAAUCAUG-3'    (SEQ ID NO: 2239)
                 3'-AGGUCGUAAAAAUGCCUGGGUUAGUAC-5'    (SEQ ID NO: 439)
MET-1370 Target: 5'-TCCAGCATTTTTACGGACCCAATCATG-3'    (SEQ ID NO: 799)

5'-CCAGCAUUUUUACGGACCCAAUCAUGA-3'    (SEQ ID NO: 2240)
                 3'-GGUCGUAAAAAUGCCUGGGUUAGUACU-5'    (SEQ ID NO: 440)
MET-1371 Target: 5'-CCAGCATTTTTACGGACCCAATCATGA-3'    (SEQ ID NO: 800)

5'-AGUUUACCACAGCUUUGCAGCGCGUUG-3'    (SEQ ID NO: 2241)
                 3'-UCAAAUGGUGUCGAAACGUCGCGCAAC-5'    (SEQ ID NO: 441)
MET-1469 Target: 5'-AGTTTACCACAGCTTTGCAGCGCGTTG-3'    (SEQ ID NO: 801)

5'-UUUACCACAGCUUUGCAGCGCGUUGAC-3'    (SEQ ID NO: 2242)
                 3'-AAAUGGUGUCGAAACGUCGCGCAACUG-5'    (SEQ ID NO: 442)
MET-1471 Target: 5'-TTTACCACAGCTTTGCAGCGCGTTGAC-3'    (SEQ ID NO: 802)

5'-UACCACAGCUUUGCAGCGCGUUGACUU-3'    (SEQ ID NO: 2243)
                 3'-AUGGUGUCGAAACGUCGCGCAACUGAA-5'    (SEQ ID NO: 443)
MET-1473 Target: 5'-TACCACAGCTTTGCAGCGCGTTGACTT-3'    (SEQ ID NO: 803)

5'-ACCACAGCUUUGCAGCGCGUUGACUUA-3'    (SEQ ID NO: 2244)
                 3'-UGGUGUCGAAACGUCGCGCAACUGAAU-5'    (SEQ ID NO: 444)
MET-1474 Target: 5'-ACCACAGCTTTGCAGCGCGTTGACTTA-3'    (SEQ ID NO: 804)

5'-CACAGCUUUGCAGCGCGUUGACUUAUU-3'    (SEQ ID NO: 2245)
                 3'-GUGUCGAAACGUCGCGCAACUGAAUAA-5'    (SEQ ID NO: 445)
MET-1476 Target: 5'-CACAGCTTTGCAGCGCGTTGACTTATT-3'    (SEQ ID NO: 805)

5'-CAGCUUUGCAGCGCGUUGACUUAUUCA-3'    (SEQ ID NO: 2246)
                 3'-GUCGAAACGUCGCGCAACUGAAUAAGU-5'    (SEQ ID NO: 446)
MET-1478 Target: 5'-CAGCTTTGCAGCGCGTTGACTTATTCA-3'    (SEQ ID NO: 806)

5'-AGCUUUGCAGCGCGUUGACUUAUUCAU-3'    (SEQ ID NO: 2247)
                 3'-UCGAAACGUCGCGCAACUGAAUAAGUA-5'    (SEQ ID NO: 447)
MET-1479 Target: 5'-AGCTTTGCAGCGCGTTGACTTATTCAT-3'    (SEQ ID NO: 807)

5'-GCUUUGCAGCGCGUUGACUUAUUCAUG-3'    (SEQ ID NO: 2248)
                 3'-CGAAACGUCGCGCAACUGAAUAAGUAC-5'    (SEQ ID NO: 448)
MET-1480 Target: 5'-GCTTTGCAGCGCGTTGACTTATTCATG-3'    (SEQ ID NO: 808)

5'-CUUUGCAGCGCGUUGACUUAUUCAUGG-3'    (SEQ ID NO: 2249)
                 3'-GAAACGUCGCGCAACUGAAUAAGUACC-5'    (SEQ ID NO: 449)
MET-1481 Target: 5'-CTTTGCAGCGCGTTGACTTATTCATGG-3'    (SEQ ID NO: 809)

5'-GCUGACCAUAUGUGGCUGGGACUUUGG-3'    (SEQ ID NO: 2250)
                 3'-CGACUGGUAUACACCGACCCUGAAACC-5'    (SEQ ID NO: 450)
MET-1953 Target: 5'-GCTGACCATATGTGGCTGGGACTTTGG-3'    (SEQ ID NO: 810)

5'-CUGACCAUAUGUGGCUGGGACUUUGGA-3'    (SEQ ID NO: 2251)
                 3'-GACUGGUAUACACCGACCCUGAAACCU-5'    (SEQ ID NO: 451)
MET-1954 Target: 5'-CTGACCATATGTGGCTGGGACTTTGGA-3'    (SEQ ID NO: 811)
```

TABLE 9-continued

Selected Human Anti-MET "Blunt/Blunt" DsiRNAs

```
              5'-UGACCAUAUGUGGCUGGGACUUUGGAU-3'  (SEQ ID NO: 2252)
              3'-ACUGGUAUACACCGACCCUGAAACCUA-5'  (SEQ ID NO: 452)
MET-1955 Target: 5'-TGACCATATGTGGCTGGGACTTTGGAT-3'  (SEQ ID NO: 812)

5'-GACCAUAUGUGGCUGGGACUUUGGAUU-3'  (SEQ ID NO: 2253)
              3'-CUGGUAUACACCGACCCUGAAACCUAA-5'  (SEQ ID NO: 453)
MET-1956 Target: 5'-GACCATATGTGGCTGGGACTTTGGATT-3'  (SEQ ID NO: 813)

5'-ACCAUAUGUGGCUGGGACUUUGGAUUU-3'  (SEQ ID NO: 2254)
              3'-UGGUAUACACCGACCCUGAAACCUAAA-5'  (SEQ ID NO: 454)
MET-1957 Target: 5'-ACCATATGTGGCTGGGACTTTGGATTT-3'  (SEQ ID NO: 814)

5'-CCAUAUGUGGCUGGGACUUUGGAUUUC-3'  (SEQ ID NO: 2255)
              3'-GGUAUACACCGACCCUGAAACCUAAAG-5'  (SEQ ID NO: 455)
MET-1958 Target: 5'-CCATATGTGGCTGGGACTTTGGATTTC-3'  (SEQ ID NO: 815)

5'-CAUAUGUGGCUGGGACUUUGGAUUUCG-3'  (SEQ ID NO: 2256)
              3'-GUAUACACCGACCCUGAAACCUAAAGC-5'  (SEQ ID NO: 456)
MET-1959 Target: 5'-CATATGTGGCTGGGACTTTGGATTTCG-3'  (SEQ ID NO: 816)

5'-AUAUGUGGCUGGGACUUUGGAUUUCGG-3'  (SEQ ID NO: 2257)
              3'-UAUACACCGACCCUGAAACCUAAAGCC-5'  (SEQ ID NO: 457)
MET-1960 Target: 5'-ATATGTGGCTGGGACTTTGGATTTCGG-3'  (SEQ ID NO: 817)

5'-UAUGUGGCUGGGACUUUGGAUUUCGGA-3'  (SEQ ID NO: 2258)
              3'-AUACACCGACCCUGAAACCUAAAGCCU-5'  (SEQ ID NO: 458)
MET-1961 Target: 5'-TATGTGGCTGGGACTTTGGATTTCGGA-3'  (SEQ ID NO: 818)

5'-AUGUGGCUGGGACUUUGGAUUUCGGAG-3'  (SEQ ID NO: 2259)
              3'-UACACCGACCCUGAAACCUAAAGCCUC-5'  (SEQ ID NO: 459)
MET-1962 Target: 5'-ATGTGGCTGGGACTTTGGATTTCGGAG-3'  (SEQ ID NO: 819)

5'-UUCGGAGGAAUAAUAAAUUUGAUUUAA-3'  (SEQ ID NO: 2260)
              3'-AAGCCUCCUUAUUAUUUAAACUAAAUU-5'  (SEQ ID NO: 460)
MET-1982 Target: 5'-TTCGGAGGAATAATAAATTTGATTTAA-3'  (SEQ ID NO: 820)

5'-AGGAAUAAUAAAUUUGAUUUAAAGAAA-3'  (SEQ ID NO: 2261)
              3'-UCCUUAUUAUUUAAACUAAAUUUCUUU-5'  (SEQ ID NO: 461)
MET-1987 Target: 5'-AGGAATAATAAATTTGATTTAAAGAAA-3'  (SEQ ID NO: 821)

5'-GGAAUAAUAAAUUUGAUUUAAAGAAAA-3'  (SEQ ID NO: 2262)
              3'-CCUUAUUAUUUAAACUAAAUUUCUUUU-5'  (SEQ ID NO: 462)
MET-1988 Target: 5'-GGAATAATAAATTTGATTTAAAGAAAA-3'  (SEQ ID NO: 822)

5'-CAUUGAAAUGCACAGUUGGUCCUGCCA-3'  (SEQ ID NO: 2263)
              3'-GUAACUUUACGUGUCAACCAGGACGGU-5'  (SEQ ID NO: 463)
MET-2075 Target: 5'-CATTGAAATGCACAGTTGGTCCTGCCA-3'  (SEQ ID NO: 823)

5'-AUUGAAAUGCACAGUUGGUCCUGCCAU-3'  (SEQ ID NO: 2264)
              3'-UAACUUUACGUGUCAACCAGGACGGUA-5'  (SEQ ID NO: 464)
MET-2076 Target: 5'-ATTGAAATGCACAGTTGGTCCTGCCAT-3'  (SEQ ID NO: 824)

5'-UUCAAUAUGUCCAUAAUUAUUUCAAAU-3'  (SEQ ID NO: 2265)
              3'-AAGUUAUACAGGUAUUAAUAAAGUUUA-5'  (SEQ ID NO: 465)
MET-2113 Target: 5'-TTCAATATGTCCATAATTATTTCAAAT-3'  (SEQ ID NO: 825)

5'-GGUGGAAAAACAUGUACUUUAAAAAGU-3'  (SEQ ID NO: 2266)
              3'-CCACCUUUUUGUACAUGAAAUUUUUCA-5'  (SEQ ID NO: 466)
MET-2290 Target: 5'-GGTGGAAAAACATGTACTTTAAAAAGT-3'  (SEQ ID NO: 826)

5'-UGUACCACUCCUUCCCUGCAACAGCUG-3'  (SEQ ID NO: 2267)
              3'-ACAUGGUGAGGAAGGGACGUUGUCGAC-5'  (SEQ ID NO: 467)
MET-2668 Target: 5'-TGTACCACTCCTTCCCTGCAACAGCTG-3'  (SEQ ID NO: 827)

5'-UAAGCCUUUUGAAAAGCCAGUGAUGAU-3'  (SEQ ID NO: 2268)
              3'-AUUCGGAAAACUUUUCGGUCACUACUA-5'  (SEQ ID NO: 468)
MET-2790 Target: 5'-TAAGCCTTTTGAAAAGCCAGTGATGAT-3'  (SEQ ID NO: 828)

5'-UGAUAUUGACCCUGAAGCAGUUAAAGG-3'  (SEQ ID NO: 2269)
              3'-ACUAUAACUGGGACUUCGUCAAUUUCC-5'  (SEQ ID NO: 469)
MET-2856 Target: 5'-TGATATTGACCCTGAAGCAGTTAAAGG-3'  (SEQ ID NO: 829)

5'-GAUAUUGACCCUGAAGCAGUUAAAGGU-3'  (SEQ ID NO: 2270)
              3'-CUAUAACUGGGACUUCGUCAAUUUCCA-5'  (SEQ ID NO: 470)
MET-2857 Target: 5'-GATATTGACCCTGAAGCAGTTAAAGGT-3'  (SEQ ID NO: 830)
```

TABLE 9-continued

Selected Human Anti-MET "Blunt/Blunt" DsiRNAs

```
              5'-AUAUUGACCCUGAAGCAGUUAAAGGUG-3'   (SEQ ID NO: 2271)
              3'-UAUAACUGGGACUUCGUCAAUUUCCAC-5'   (SEQ ID NO:  471)
MET-2858 Target: 5'-ATATTGACCCTGAAGCAGTTAAAGGTG-3' (SEQ ID NO:  831)

5'-UAUUGACCCUGAAGCAGUUAAAGGUGA-3'   (SEQ ID NO: 2272)
              3'-AUAACUGGGACUUCGUCAAUUUCCACU-5'   (SEQ ID NO:  472)
MET-2859 Target: 5'-TATTGACCCTGAAGCAGTTAAAGGTGA-3' (SEQ ID NO:  832)

5'-AUUGACCCUGAAGCAGUUAAAGGUGAA-3'   (SEQ ID NO: 2273)
              3'-UAACUGGGACUUCGUCAAUUUCCACUU-5'   (SEQ ID NO:  473)
MET-2860 Target: 5'-ATTGACCCTGAAGCAGTTAAAGGTGAA-3' (SEQ ID NO:  833)

5'-UUGACCCUGAAGCAGUUAAAGGUGAAG-3'   (SEQ ID NO: 2274)
              3'-AACUGGGACUUCGUCAAUUUCCACUUC-5'   (SEQ ID NO:  474)
MET-2861 Target: 5'-TTGACCCTGAAGCAGTTAAAGGTGAAG-3' (SEQ ID NO:  834)

5'-UGACCCUGAAGCAGUUAAAGGUGAAGU-3'   (SEQ ID NO: 2275)
              3'-ACUGGGACUUCGUCAAUUUCCACUUCA-5'   (SEQ ID NO:  475)
MET-2862 Target: 5'-TGACCCTGAAGCAGTTAAAGGTGAAGT-3' (SEQ ID NO:  835)

5'-GACCCUGAAGCAGUUAAAGGUGAAGUG-3'   (SEQ ID NO: 2276)
              3'-CUGGGACUUCGUCAAUUUCCACUUCAC-5'   (SEQ ID NO:  476)
MET-2863 Target: 5'-GACCCTGAAGCAGTTAAAGGTGAAGTG-3' (SEQ ID NO:  836)

5'-ACCCUGAAGCAGUUAAAGGUGAAGUGU-3'   (SEQ ID NO: 2277)
              3'-UGGGACUUCGUCAAUUUCCACUUCACA-5'   (SEQ ID NO:  477)
MET-2864 Target: 5'-ACCCTGAAGCAGTTAAAGGTGAAGTGT-3' (SEQ ID NO:  837)

5'-CCCUGAAGCAGUUAAAGGUGAAGUGUU-3'   (SEQ ID NO: 2278)
              3'-GGGACUUCGUCAAUUUCCACUUCACAA-5'   (SEQ ID NO:  478)
MET-2865 Target: 5'-CCCTGAAGCAGTTAAAGGTGAAGTGTT-3' (SEQ ID NO:  838)

5'-CCUGAAGCAGUUAAAGGUGAAGUGUUA-3'   (SEQ ID NO: 2279)
              3'-GGACUUCGUCAAUUUCCACUUCACAAU-5'   (SEQ ID NO:  479)
MET-2866 Target: 5'-CCTGAAGCAGTTAAAGGTGAAGTGTTA-3' (SEQ ID NO:  839)

5'-CUGAAGCAGUUAAAGGUGAAGUGUUAA-3'   (SEQ ID NO: 2280)
              3'-GACUUCGUCAAUUUCCACUUCACAAUU-5'   (SEQ ID NO:  480)
MET-2867 Target: 5'-CTGAAGCAGTTAAAGGTGAAGTGTTAA-3' (SEQ ID NO:  840)

5'-UGAAGCAGUUAAAGGUGAAGUGUUAAA-3'   (SEQ ID NO: 2281)
              3'-ACUUCGUCAAUUUCCACUUCACAAUUU-5'   (SEQ ID NO:  481)
MET-2868 Target: 5'-TGAAGCAGTTAAAGGTGAAGTGTTAAA-3' (SEQ ID NO:  841)

5'-GAAGCAGUUAAAGGUGAAGUGUUAAAA-3'   (SEQ ID NO: 2282)
              3'-CUUCGUCAAUUUCCACUUCACAAUUUU-5'   (SEQ ID NO:  482)
MET-2869 Target: 5'-GAAGCAGTTAAAGGTGAAGTGTTAAAA-3' (SEQ ID NO:  842)

5'-AAGCAGUUAAAGGUGAAGUGUUAAAAG-3'   (SEQ ID NO: 2283)
              3'-UUCGUCAAUUUCCACUUCACAAUUUUC-5'   (SEQ ID NO:  483)
MET-2870 Target: 5'-AAGCAGTTAAAGGTGAAGTGTTAAAAG-3' (SEQ ID NO:  843)

5'-AGCAGUUAAAGGUGAAGUGUUAAAAGU-3'   (SEQ ID NO: 2284)
              3'-UCGUCAAUUUCCACUUCACAAUUUUCA-5'   (SEQ ID NO:  484)
MET-2871 Target: 5'-AGCAGTTAAAGGTGAAGTGTTAAAAGT-3' (SEQ ID NO:  844)

5'-GCAGUUAAAGGUGAAGUGUUAAAAGUU-3'   (SEQ ID NO: 2285)
              3'-CGUCAAUUUCCACUUCACAAUUUUCAA-5'   (SEQ ID NO:  485)
MET-2872 Target: 5'-GCAGTTAAAGGTGAAGTGTTAAAAGTT-3' (SEQ ID NO:  845)

5'-CAGUUAAAGGUGAAGUGUUAAAAGUUG-3'   (SEQ ID NO: 2286)
              3'-GUCAAUUUCCACUUCACAAUUUUCAAC-5'   (SEQ ID NO:  486)
MET-2873 Target: 5'-CAGTTAAAGGTGAAGTGTTAAAAGTTG-3' (SEQ ID NO:  846)

5'-AGUUAAAGGUGAAGUGUUAAAAGUUGG-3'   (SEQ ID NO: 2287)
              3'-UCAAUUUCCACUUCACAAUUUUCAACC-5'   (SEQ ID NO:  487)
MET-2874 Target: 5'-AGTTAAAGGTGAAGTGTTAAAAGTTGG-3' (SEQ ID NO:  847)

5'-GUUAAAGGUGAAGUGUUAAAAGUUGGA-3'   (SEQ ID NO: 2288)
              3'-CAAUUUCCACUUCACAAUUUUCAACCU-5'   (SEQ ID NO:  488)
MET-2875 Target: 5'-GTTAAAGGTGAAGTGTTAAAAGTTGGA-3' (SEQ ID NO:  848)

5'-UUAAAGGUGAAGUGUUAAAAGUUGGAA-3'   (SEQ ID NO: 2289)
              3'-AAUUUCCACUUCACAAUUUUCAACCUU-5'   (SEQ ID NO:  489)
MET-2876 Target: 5'-TTAAAGGTGAAGTGTTAAAAGTTGGAA-3' (SEQ ID NO:  849)
```

TABLE 9-continued

Selected Human Anti-MET "Blunt/Blunt" DsiRNAs

```
                5'-UAAAGGUGAAGUGUUAAAAGUUGGAAA-3'      (SEQ ID NO: 2290)
                3'-AUUUCCACUUCACAAUUUUCAACCUUU-5'      (SEQ ID NO: 490)
MET-2877 Target: 5'-TAAAGGTGAAGTGTTAAAAGTTGGAAA-3'     (SEQ ID NO: 850)

5'-AAAGGUGAAGUGUUAAAAGUUGGAAAU-3'     (SEQ ID NO: 2291)
                3'-UUUCCACUUCACAAUUUUCAACCUUUA-5'      (SEQ ID NO: 491)
MET-2878 Target: 5'-AAAGGTGAAGTGTTAAAAGTTGGAAAT-3'     (SEQ ID NO: 851)

5'-AAGGUGAAGUGUUAAAAGUUGGAAAUA-3'      (SEQ ID NO: 2292)
                3'-UUCCACUUCACAAUUUUCAACCUUUAU-5'      (SEQ ID NO: 492)
MET-2879 Target: 5'-AAGGTGAAGTGTTAAAAGTTGGAAATA-3'     (SEQ ID NO: 852)

5'-AGGUGAAGUGUUAAAAGUUGGAAAUAA-3'      (SEQ ID NO: 2293)
                3'-UCCACUUCACAAUUUUCAACCUUUAUU-5'      (SEQ ID NO: 493)
MET-2880 Target: 5'-AGGTGAAGTGTTAAAAGTTGGAAATAA-3'     (SEQ ID NO: 853)

5'-GGUGAAGUGUUAAAAGUUGGAAAUAAG-3'      (SEQ ID NO: 2294)
                3'-CCACUUCACAAUUUUCAACCUUUAUUC-5'      (SEQ ID NO: 494)
MET-2881 Target: 5'-GGTGAAGTGTTAAAAGTTGGAAATAAG-3'     (SEQ ID NO: 854)

5'-GUGAAGUGUUAAAAGUUGGAAAUAAGA-3'      (SEQ ID NO: 2295)
                3'-CACUUCACAAUUUUCAACCUUUAUUCU-5'      (SEQ ID NO: 495)
MET-2882 Target: 5'-GTGAAGTGTTAAAAGTTGGAAATAAGA-3'     (SEQ ID NO: 855)

5'-UGAAGUGUUAAAAGUUGGAAAUAAGAG-3'      (SEQ ID NO: 2296)
                3'-ACUUCACAAUUUUCAACCUUUAUUCUC-5'      (SEQ ID NO: 496)
MET-2883 Target: 5'-TGAAGTGTTAAAAGTTGGAAATAAGAG-3'     (SEQ ID NO: 856)

5'-GAAGUGUUAAAAGUUGGAAAUAAGAGC-3'      (SEQ ID NO: 2297)
                3'-CUUCACAAUUUUCAACCUUUAUUCUCG-5'      (SEQ ID NO: 497)
MET-2884 Target: 5'-GAAGTGTTAAAAGTTGGAAATAAGAGC-3'     (SEQ ID NO: 857)

5'-AUUGAACAGCGAGCUAAAUAUAGAGUG-3'      (SEQ ID NO: 2298)
                3'-UAACUUGUCGCUCGAUUUAUAUCUCAC-5'      (SEQ ID NO: 498)
MET-2973 Target: 5'-ATTGAACAGCGAGCTAAATATAGAGTG-3'     (SEQ ID NO: 858)

5'-UUGAACAGCGAGCUAAAUAUAGAGUGG-3'      (SEQ ID NO: 2299)
                3'-AACUUGUCGCUCGAUUUAUAUCUCACC-5'      (SEQ ID NO: 499)
MET-2974 Target: 5'-TTGAACAGCGAGCTAAATATAGAGTGG-3'     (SEQ ID NO: 859)

5'-UGAACAGCGAGCUAAAUAUAGAGUGGA-3'      (SEQ ID NO: 2300)
                3'-ACUUGUCGCUCGAUUUAUAUCUCACCU-5'      (SEQ ID NO: 500)
MET-2975 Target: 5'-TGAACAGCGAGCTAAATATAGAGTGGA-3'     (SEQ ID NO: 860)

5'-GAACAGCGAGCUAAAUAUAGAGUGGAA-3'      (SEQ ID NO: 2301)
                3'-CUUGUCGCUCGAUUUAUAUCUCACCUU-5'      (SEQ ID NO: 501)
MET-2976 Target: 5'-GAACAGCGAGCTAAATATAGAGTGGAA-3'     (SEQ ID NO: 861)

5'-AACAGCGAGCUAAAUAUAGAGUGGAAG-3'      (SEQ ID NO: 2302)
                3'-UUGUCGCUCGAUUUAUAUCUCACCUUC-5'      (SEQ ID NO: 502)
MET-2977 Target: 5'-AACAGCGAGCTAAATATAGAGTGGAAG-3'     (SEQ ID NO: 862)

5'-ACAGCGAGCUAAAUAUAGAGUGGAAGC-3'      (SEQ ID NO: 2303)
                3'-UGUCGCUCGAUUUAUAUCUCACCUUCG-5'      (SEQ ID NO: 503)
MET-2978 Target: 5'-ACAGCGAGCTAAATATAGAGTGGAAGC-3'     (SEQ ID NO: 863)

5'-CAGCGAGCUAAAUAUAGAGUGGAAGCA-3'      (SEQ ID NO: 2304)
                3'-GUCGCUCGAUUUAUAUCUCACCUUCGU-5'      (SEQ ID NO: 504)
MET-2979 Target: 5'-CAGCGAGCTAAATATAGAGTGGAAGCA-3'     (SEQ ID NO: 864)

5'-AGCGAGCUAAAUAUAGAGUGGAAGCAA-3'      (SEQ ID NO: 2305)
                3'-UCGCUCGAUUUAUAUCUCACCUUCGUU-5'      (SEQ ID NO: 505)
MET-2980 Target: 5'-AGCGAGCTAAATATAGAGTGGAAGCAA-3'     (SEQ ID NO: 865)

5'-GCGAGCUAAAUAUAGAGUGGAAGCAAG-3'      (SEQ ID NO: 2306)
                3'-CGCUCGAUUUAUAUCUCACCUUCGUUC-5'      (SEQ ID NO: 506)
MET-2981 Target: 5'-GCGAGCTAAATATAGAGTGGAAGCAAG-3'     (SEQ ID NO: 866)

5'-CGAGCUAAAUAUAGAGUGGAAGCAAGC-3'      (SEQ ID NO: 2307)
                3'-GCUCGAUUUAUAUCUCACCUUCGUUCG-5'      (SEQ ID NO: 507)
MET-2982 Target: 5'-CGAGCTAAATATAGAGTGGAAGCAAGC-3'     (SEQ ID NO: 867)

5'-GAGCUAAAUAUAGAGUGGAAGCAAGCA-3'      (SEQ ID NO: 2308)
                3'-CUCGAUUUAUAUCUCACCUUCGUUCGU-5'      (SEQ ID NO: 508)
MET-2983 Target: 5'-GAGCTAAATATAGAGTGGAAGCAAGCA-3'     (SEQ ID NO: 868)
```

TABLE 9-continued

Selected Human Anti-MET "Blunt/Blunt" DsiRNAs

```
             5'-AGCUAAAUAUAGAGUGGAAGCAAGCAA-3'   (SEQ ID NO: 2309)
             3'-UCGAUUUAUAUCUCACCUUCGUUCGUU-5'   (SEQ ID NO:  509)
MET-2984 Target: 5'-AGCTAAATATAGAGTGGAAGCAAGCAA-3' (SEQ ID NO:  869)

5'-GCUAAAUAUAGAGUGGAAGCAAGCAAU-3'   (SEQ ID NO: 2310)
             3'-CGAUUUAUAUCUCACCUUCGUUCGUUA-5'   (SEQ ID NO:  510)
MET-2985 Target: 5'-GCTAAATATAGAGTGGAAGCAAGCAAT-3' (SEQ ID NO:  870)

5'-CUAAAUAUAGAGUGGAAGCAAGCAAUU-3'   (SEQ ID NO: 2311)
             3'-GAUUUAUAUCUCACCUUCGUUCGUUAA-5'   (SEQ ID NO:  511)
MET-2986 Target: 5'-CTAAATATAGAGTGGAAGCAAGCAATT-3' (SEQ ID NO:  871)

5'-UAAAUAUAGAGUGGAAGCAAGCAAUUU-3'   (SEQ ID NO: 2312)
             3'-AUUUAUAUCUCACCUUCGUUCGUUAAA-5'   (SEQ ID NO:  512)
MET-2987 Target: 5'-TAAATATAGAGTGGAAGCAAGCAATTT-3' (SEQ ID NO:  872)

5'-AAAUAUAGAGUGGAAGCAAGCAAUUUC-3'   (SEQ ID NO: 2313)
             3'-UUUAUAUCUCACCUUCGUUCGUUAAAG-5'   (SEQ ID NO:  513)
MET-2988 Target: 5'-AAATATAGAGTGGAAGCAAGCAATTTC-3' (SEQ ID NO:  873)

5'-AAUAUAGAGUGGAAGCAAGCAAUUUCU-3'   (SEQ ID NO: 2314)
             3'-UUUAUAUCUCACCUUCGUUCGUUAAAGA-5'  (SEQ ID NO:  514)
MET-2989 Target: 5'-AATATAGAGTGGAAGCAAGCAATTTCT-3' (SEQ ID NO:  874)

5'-CUUGGGUUUUUCCUGUGGCUGAAAAAG-3'   (SEQ ID NO: 2315)
             3'-GAACCCAAAAAGGACACCGACUUUUUC-5'   (SEQ ID NO:  515)
MET-3112 Target: 5'-CTTGGGTTTTTCCTGTGGCTGAAAAAG-3' (SEQ ID NO:  875)

5'-GUGGCUGAAAAAGAGAAAGCAAAUUAA-3'   (SEQ ID NO: 2316)
             3'-CACCGACUUUUUCUCUUUCGUUUAAUU-5'   (SEQ ID NO:  516)
MET-3126 Target: 5'-GTGGCTGAAAAAGAGAAAGCAAATTAA-3' (SEQ ID NO:  876)

5'-AUUAAAGAUCUGGGCAGUGAAUUAGUU-3'   (SEQ ID NO: 2317)
             3'-UAAUUUCUAGACCCGUCACUUAAUCAA-5'   (SEQ ID NO:  517)
MET-3148 Target: 5'-ATTAAAGATCTGGGCAGTGAATTAGTT-3' (SEQ ID NO:  877)

5'-UUAAAGAUCUGGGCAGUGAAUUAGUUC-3'   (SEQ ID NO: 2318)
             3'-AAUUUCUAGACCCGUCACUUAAUCAAG-5'   (SEQ ID NO:  518)
MET-3149 Target: 5'-TTAAAGATCTGGGCAGTGAATTAGTTC-3' (SEQ ID NO:  878)

5'-UAAAGAUCUGGGCAGUGAAUUAGUUCG-3'   (SEQ ID NO: 2319)
             3'-AUUUCUAGACCCGUCACUUAAUCAAGC-5'   (SEQ ID NO:  519)
MET-3150 Target: 5'-TAAAGATCTGGGCAGTGAATTAGTTCG-3' (SEQ ID NO:  879)

5'-AAAGAUCUGGGCAGUGAAUUAGUUCGC-3'   (SEQ ID NO: 2320)
             3'-UUUCUAGACCCGUCACUUAAUCAAGCG-5'   (SEQ ID NO:  520)
MET-3151 Target: 5'-AAAGATCTGGGCAGTGAATTAGTTCGC-3' (SEQ ID NO:  880)

5'-AAGAUCUGGGCAGUGAAUUAGUUCGCU-3'   (SEQ ID NO: 2321)
             3'-UUCUAGACCCGUCACUUAAUCAAGCGA-5'   (SEQ ID NO:  521)
MET-3152 Target: 5'-AAGATCTGGGCAGTGAATTAGTTCGCT-3' (SEQ ID NO:  881)

5'-AGAUCUGGGCAGUGAAUUAGUUCGCUA-3'   (SEQ ID NO: 2322)
             3'-UCUAGACCCGUCACUUAAUCAAGCGAU-5'   (SEQ ID NO:  522)
MET-3153 Target: 5'-AGATCTGGGCAGTGAATTAGTTCGCTA-3' (SEQ ID NO:  882)

5'-GAUCUGGGCAGUGAAUUAGUUCGCUAC-3'   (SEQ ID NO: 2323)
             3'-CUAGACCCGUCACUUAAUCAAGCGAUG-5'   (SEQ ID NO:  523)
MET-3154 Target: 5'-GATCTGGGCAGTGAATTAGTTCGCTAC-3' (SEQ ID NO:  883)

5'-AUCUGGGCAGUGAAUUAGUUCGCUACG-3'   (SEQ ID NO: 2324)
             3'-UAGACCCGUCACUUAAUCAAGCGAUGC-5'   (SEQ ID NO:  524)
MET-3155 Target: 5'-ATCTGGGCAGTGAATTAGTTCGCTACG-3' (SEQ ID NO:  884)

5'-UCUGGGCAGUGAAUUAGUUCGCUACGA-3'   (SEQ ID NO: 2325)
             3'-AGACCCGUCACUUAAUCAAGCGAUGCU-5'   (SEQ ID NO:  525)
MET-3156 Target: 5'-TCTGGGCAGTGAATTAGTTCGCTACGA-3' (SEQ ID NO:  885)

5'-CUGGGCAGUGAAUUAGUUCGCUACGAU-3'   (SEQ ID NO: 2326)
             3'-GACCCGUCACUUAAUCAAGCGAUGCUA-5'   (SEQ ID NO:  526)
MET-3157 Target: 5'-CTGGGCAGTGAATTAGTTCGCTACGAT-3' (SEQ ID NO:  886)

5'-UGGGCAGUGAAUUAGUUCGCUACGAUG-3'   (SEQ ID NO: 2327)
             3'-ACCCGUCACUUAAUCAAGCGAUGCUAC-5'   (SEQ ID NO:  527)
MET-3158 Target: 5'-TGGGCAGTGAATTAGTTCGCTACGATG-3' (SEQ ID NO:  887)
```

TABLE 9-continued

Selected Human Anti-MET "Blunt/Blunt" DsiRNAs

```
                  5'-GGGCAGUGAAUUAGUUCGCUACGAUGC-3'  (SEQ ID NO: 2328)
                  3'-CCCGUCACUUAAUCAAGCGAUGCUACG-5'  (SEQ ID NO: 528)
MET-3159 Target:  5'-GGGCAGTGAATTAGTTCGCTACGATGC-3'  (SEQ ID NO: 888)

5'-CACACUCCUCAUUUGGAUAGGCUUGUA-3'  (SEQ ID NO: 2329)
                  3'-GUGUGAGGAGUAAACCUAUCCGAACAU-5'  (SEQ ID NO: 529)
MET-3193 Target:  5'-CACACTCCTCATTTGGATAGGCTTGTA-3'  (SEQ ID NO: 889)

5'-ACACUCCUCAUUUGGAUAGGCUUGUAA-3'  (SEQ ID NO: 2330)
                  3'-UGUGAGGAGUAAACCUAUCCGAACAUU-5'  (SEQ ID NO: 530)
MET-3194 Target:  5'-ACACTCCTCATTTGGATAGGCTTGTAA-3'  (SEQ ID NO: 890)

5'-CACUCCUCAUUUGGAUAGGCUUGUAAG-3'  (SEQ ID NO: 2331)
                  3'-GUGAGGAGUAAACCUAUCCGAACAUUC-5'  (SEQ ID NO: 531)
MET-3195 Target:  5'-CACTCCTCATTTGGATAGGCTTGTAAG-3'  (SEQ ID NO: 891)

5'-ACUCCUCAUUUGGAUAGGCUUGUAAGU-3'  (SEQ ID NO: 2332)
                  3'-UGAGGAGUAAACCUAUCCGAACAUUCA-5'  (SEQ ID NO: 532)
MET-3196 Target:  5'-ACTCCTCATTTGGATAGGCTTGTAAGT-3'  (SEQ ID NO: 892)

5'-CUCCUCAUUUGGAUAGGCUUGUAAGUG-3'  (SEQ ID NO: 2333)
                  3'-GAGGAGUAAACCUAUCCGAACAUUCAC-5'  (SEQ ID NO: 533)
MET-3197 Target:  5'-CTCCTCATTTGGATAGGCTTGTAAGTG-3'  (SEQ ID NO: 893)

5'-UCCUCAUUUGGAUAGGCUUGUAAGUGC-3'  (SEQ ID NO: 2334)
                  3'-AGGAGUAAACCUAUCCGAACAUUCACG-5'  (SEQ ID NO: 534)
MET-3198 Target:  5'-TCCTCATTTGGATAGGCTTGTAAGTGC-3'  (SEQ ID NO: 894)

5'-CCUCAUUUGGAUAGGCUUGUAAGUGCC-3'  (SEQ ID NO: 2335)
                  3'-GGAGUAAACCUAUCCGAACAUUCACGG-5'  (SEQ ID NO: 535)
MET-3199 Target:  5'-CCTCATTTGGATAGGCTTGTAAGTGCC-3'  (SEQ ID NO: 895)

5'-CUCAUUUGGAUAGGCUUGUAAGUGCCC-3'  (SEQ ID NO: 2336)
                  3'-GAGUAAACCUAUCCGAACAUUCACGGG-5'  (SEQ ID NO: 536)
MET-3200 Target:  5'-CTCATTTGGATAGGCTTGTAAGTGCCC-3'  (SEQ ID NO: 896)

5'-UCAUUUGGAUAGGCUUGUAAGUGCCCG-3'  (SEQ ID NO: 2337)
                  3'-AGUAAACCUAUCCGAACAUUCACGGGC-5'  (SEQ ID NO: 537)
MET-3201 Target:  5'-TCATTTGGATAGGCTTGTAAGTGCCCG-3'  (SEQ ID NO: 897)

5'-CAUUUGGAUAGGCUUGUAAGUGCCCGA-3'  (SEQ ID NO: 2338)
                  3'-GUAAACCUAUCCGAACAUUCACGGGCU-5'  (SEQ ID NO: 538)
MET-3202 Target:  5'-CATTTGGATAGGCTTGTAAGTGCCCGA-3'  (SEQ ID NO: 898)

5'-AUUUGGAUAGGCUUGUAAGUGCCCGAA-3'  (SEQ ID NO: 2339)
                  3'-UAAACCUAUCCGAACAUUCACGGGCUU-5'  (SEQ ID NO: 539)
MET-3203 Target:  5'-ATTTGGATAGGCTTGTAAGTGCCCGAA-3'  (SEQ ID NO: 899)

5'-UUUGGAUAGGCUUGUAAGUGCCCGAAG-3'  (SEQ ID NO: 2340)
                  3'-AAACCUAUCCGAACAUUCACGGGCUUC-5'  (SEQ ID NO: 540)
MET-3204 Target:  5'-TTTGGATAGGCTTGTAAGTGCCCGAAG-3'  (SEQ ID NO: 900)

5'-UUGGAUAGGCUUGUAAGUGCCCGAAGU-3'  (SEQ ID NO: 2341)
                  3'-AACCUAUCCGAACAUUCACGGGCUUCA-5'  (SEQ ID NO: 541)
MET-3205 Target:  5'-TTGGATAGGCTTGTAAGTGCCCGAAGT-3'  (SEQ ID NO: 901)

5'-UGGAUAGGCUUGUAAGUGCCCGAAGUG-3'  (SEQ ID NO: 2342)
                  3'-ACCUAUCCGAACAUUCACGGGCUUCAC-5'  (SEQ ID NO: 542)
MET-3206 Target:  5'-TGGATAGGCTTGTAAGTGCCCGAAGTG-3'  (SEQ ID NO: 902)

5'-GGAUAGGCUUGUAAGUGCCCGAAGUGU-3'  (SEQ ID NO: 2343)
                  3'-CCUAUCCGAACAUUCACGGGCUUCACA-5'  (SEQ ID NO: 543)
MET-3207 Target:  5'-GGATAGGCTTGTAAGTGCCCGAAGTGT-3'  (SEQ ID NO: 903)

5'-GAUAGGCUUGUAAGUGCCCGAAGUGUA-3'  (SEQ ID NO: 2344)
                  3'-CUAUCCGAACAUUCACGGGCUUCACAU-5'  (SEQ ID NO: 544)
MET-3208 Target:  5'-GATAGGCTTGTAAGTGCCCGAAGTGTA-3'  (SEQ ID NO: 904)

5'-AUAGGCUUGUAAGUGCCCGAAGUGUAA-3'  (SEQ ID NO: 2345)
                  3'-UAUCCGAACAUUCACGGGCUUCACAUU-5'  (SEQ ID NO: 545)
MET-3209 Target:  5'-ATAGGCTTGTAAGTGCCCGAAGTGTAA-3'  (SEQ ID NO: 905)

5'-UAGGCUUGUAAGUGCCCGAAGUGUAAG-3'  (SEQ ID NO: 2346)
                  3'-AUCCGAACAUUCACGGGCUUCACAUUC-5'  (SEQ ID NO: 546)
MET-3210 Target:  5'-TAGGCTTGTAAGTGCCCGAAGTGTAAG-3'  (SEQ ID NO: 906)
```

TABLE 9-continued

Selected Human Anti-MET "Blunt/Blunt" DsiRNAs

```
              5'-AGGCUUGUAAGUGCCCGAAGUGUAAGC-3'    (SEQ ID NO: 2347)
              3'-UCCGAACAUUCACGGGCUUCACAUUCG-5'    (SEQ ID NO: 547)
MET-3211 Target: 5'-AGGCTTGTAAGTGCCCGAAGTGTAAGC-3' (SEQ ID NO: 907)

5'-GGCUUGUAAGUGCCCGAAGUGUAAGCC-3'    (SEQ ID NO: 2348)
              3'-CCGAACAUUCACGGGCUUCACAUUCGG-5'    (SEQ ID NO: 548)
MET-3212 Target: 5'-GGCTTGTAAGTGCCCGAAGTGTAAGCC-3' (SEQ ID NO: 908)

5'-GCUUGUAAGUGCCCGAAGUGUAAGCCC-3'    (SEQ ID NO: 2349)
              3'-CGAACAUUCACGGGCUUCACAUUCGGG-5'    (SEQ ID NO: 549)
MET-3213 Target: 5'-GCTTGTAAGTGCCCGAAGTGTAAGCCC-3' (SEQ ID NO: 909)

5'-CUUGUAAGUGCCCGAAGUGUAAGCCCA-3'    (SEQ ID NO: 2350)
              3'-GAACAUUCACGGGCUUCACAUUCGGGU-5'    (SEQ ID NO: 550)
MET-3214 Target: 5'-CTTGTAAGTGCCCGAAGTGTAAGCCCA-3' (SEQ ID NO: 910)

5'-UUGUAAGUGCCCGAAGUGUAAGCCCAA-3'    (SEQ ID NO: 2351)
              3'-AACAUUCACGGGCUUCACAUUCGGGUU-5'    (SEQ ID NO: 551)
MET-3215 Target: 5'-TTGTAAGTGCCCGAAGTGTAAGCCCAA-3' (SEQ ID NO: 911)

5'-UGUAAGUGCCCGAAGUGUAAGCCCAAC-3'    (SEQ ID NO: 2352)
              3'-ACAUUCACGGGCUUCACAUUCGGGUUG-5'    (SEQ ID NO: 552)
MET-3216 Target: 5'-TGTAAGTGCCCGAAGTGTAAGCCCAAC-3' (SEQ ID NO: 912)

5'-CCGAGCUACUUUUCCAGAAGAUCAGUU-3'    (SEQ ID NO: 2353)
              3'-GGCUCGAUGAAAAGGUCUUCUAGUCAA-5'    (SEQ ID NO: 553)
MET-3276 Target: 5'-CCGAGCTACTTTTCCAGAAGATCAGTT-3' (SEQ ID NO: 913)

5'-UCCACAUUGACCUCAGUGCUCUAAAUC-3'    (SEQ ID NO: 2354)
              3'-AGGUGUAACUGGAGUCACGAGAUUUAG-5'    (SEQ ID NO: 554)
MET-3419 Target: 5'-TCCACATTGACCTCAGTGCTCTAAATC-3' (SEQ ID NO: 914)

5'-CCACAUUGACCUCAGUGCUCUAAAUCC-3'    (SEQ ID NO: 2355)
              3'-GGUGUAACUGGAGUCACGAGAUUUAGG-5'    (SEQ ID NO: 555)
MET-3420 Target: 5'-CCACATTGACCTCAGTGCTCTAAATCC-3' (SEQ ID NO: 915)

5'-CACAUUGACCUCAGUGCUCUAAAUCCA-3'    (SEQ ID NO: 2356)
              3'-GUGUAACUGGAGUCACGAGAUUUAGGU-5'    (SEQ ID NO: 556)
MET-3421 Target: 5'-CACATTGACCTCAGTGCTCTAAATCCA-3' (SEQ ID NO: 916)

5'-ACAUUGACCUCAGUGCUCUAAAUCCAG-3'    (SEQ ID NO: 2357)
              3'-UGUAACUGGAGUCACGAGAUUUAGGUC-5'    (SEQ ID NO: 557)
MET-3422 Target: 5'-ACATTGACCTCAGTGCTCTAAATCCAG-3' (SEQ ID NO: 917)

5'-CAUUGACCUCAGUGCUCUAAAUCCAGA-3'    (SEQ ID NO: 2358)
              3'-GUAACUGGAGUCACGAGAUUUAGGUCU-5'    (SEQ ID NO: 558)
MET-3423 Target: 5'-CATTGACCTCAGTGCTCTAAATCCAGA-3' (SEQ ID NO: 918)

5'-AUUGACCUCAGUGCUCUAAAUCCAGAG-3'    (SEQ ID NO: 2359)
              3'-UAACUGGAGUCACGAGAUUUAGGUCUC-5'    (SEQ ID NO: 559)
MET-3424 Target: 5'-ATTGACCTCAGTGCTCTAAATCCAGAG-3' (SEQ ID NO: 919)

5'-UUGACCUCAGUGCUCUAAAUCCAGAGC-3'    (SEQ ID NO: 2360)
              3'-AACUGGAGUCACGAGAUUUAGGUCUCG-5'    (SEQ ID NO: 560)
MET-3425 Target: 5'-TTGACCTCAGTGCTCTAAATCCAGAGC-3' (SEQ ID NO: 920)

5'-UGACCUCAGUGCUCUAAAUCCAGAGCU-3'    (SEQ ID NO: 2361)
              3'-ACUGGAGUCACGAGAUUUAGGUCUCGA-5'    (SEQ ID NO: 561)
MET-3426 Target: 5'-TGACCTCAGTGCTCTAAATCCAGAGCT-3' (SEQ ID NO: 921)

5'-GACCUCAGUGCUCUAAAUCCAGAGCUG-3'    (SEQ ID NO: 2362)
              3'-CUGGAGUCACGAGAUUUAGGUCUCGAC-5'    (SEQ ID NO: 562)
MET-3427 Target: 5'-GACCTCAGTGCTCTAAATCCAGAGCTG-3' (SEQ ID NO: 922)

5'-ACCUCAGUGCUCUAAAUCCAGAGCUGG-3'    (SEQ ID NO: 2363)
              3'-UGGAGUCACGAGAUUUAGGUCUCGACC-5'    (SEQ ID NO: 563)
MET-3428 Target: 5'-ACCTCAGTGCTCTAAATCCAGAGCTGG-3' (SEQ ID NO: 923)

5'-CCUCAGUGCUCUAAAUCCAGAGCUGGU-3'    (SEQ ID NO: 2364)
              3'-GGAGUCACGAGAUUUAGGUCUCGACCA-5'    (SEQ ID NO: 564)
MET-3429 Target: 5'-CCTCAGTGCTCTAAATCCAGAGCTGGT-3' (SEQ ID NO: 924)

5'-CUCAGUGCUCUAAAUCCAGAGCUGGUC-3'    (SEQ ID NO: 2365)
              3'-GAGUCACGAGAUUUAGGUCUCGACCAG-5'    (SEQ ID NO: 565)
MET-3430 Target: 5'-CTCAGTGCTCTAAATCCAGAGCTGGTC-3' (SEQ ID NO: 925)
```

TABLE 9-continued

Selected Human Anti-MET "Blunt/Blunt" DsiRNAs

```
               5'-UCAGUGCUCUAAAUCCAGAGCUGGUCC-3'    (SEQ ID NO: 2366)
               3'-AGUCACGAGAUUUAGGUCUCGACCAGG-5'    (SEQ ID NO: 566)
MET-3431 Target: 5'-TCAGTGCTCTAAATCCAGAGCTGGTCC-3'  (SEQ ID NO: 926)

5'-CAGUGCUCUAAAUCCAGAGCUGGUCCA-3'   (SEQ ID NO: 2367)
               3'-GUCACGAGAUUUAGGUCUCGACCAGGU-5'   (SEQ ID NO: 567)
MET-3432 Target: 5'-CAGTGCTCTAAATCCAGAGCTGGTCCA-3' (SEQ ID NO: 927)

5'-AGUGCUCUAAAUCCAGAGCUGGUCCAG-3'   (SEQ ID NO: 2368)
               3'-UCACGAGAUUUAGGUCUCGACCAGGUC-5'   (SEQ ID NO: 568)
MET-3433 Target: 5'-AGTGCTCTAAATCCAGAGCTGGTCCAG-3' (SEQ ID NO: 928)

5'-GUGCUCUAAAUCCAGAGCUGGUCCAGG-3'   (SEQ ID NO: 2369)
               3'-CACGAGAUUUAGGUCUCGACCAGGUCC-5'   (SEQ ID NO: 569)
MET-3434 Target: 5'-GTGCTCTAAATCCAGAGCTGGTCCAGG-3' (SEQ ID NO: 929)

5'-UGCUCUAAAUCCAGAGCUGGUCCAGGC-3'   (SEQ ID NO: 2370)
               3'-ACGAGAUUUAGGUCUCGACCAGGUCCG-5'   (SEQ ID NO: 570)
MET-3435 Target: 5'-TGCTCTAAATCCAGAGCTGGTCCAGGC-3' (SEQ ID NO: 930)

5'-GCUCUAAAUCCAGAGCUGGUCCAGGCA-3'   (SEQ ID NO: 2371)
               3'-CGAGAUUUAGGUCUCGACCAGGUCCGU-5'   (SEQ ID NO: 571)
MET-3436 Target: 5'-GCTCTAAATCCAGAGCTGGTCCAGGCA-3' (SEQ ID NO: 931)

5'-CUCUAAAUCCAGAGCUGGUCCAGGCAG-3'   (SEQ ID NO: 2372)
               3'-GAGAUUUAGGUCUCGACCAGGUCCGUC-5'   (SEQ ID NO: 572)
MET-3437 Target: 5'-CTCTAAATCCAGAGCTGGTCCAGGCAG-3' (SEQ ID NO: 932)

5'-UCUAAAUCCAGAGCUGGUCCAGGCAGU-3'   (SEQ ID NO: 2373)
               3'-AGAUUUAGGUCUCGACCAGGUCCGUCA-5'   (SEQ ID NO: 573)
MET-3438 Target: 5'-TCTAAATCCAGAGCTGGTCCAGGCAGT-3' (SEQ ID NO: 933)

5'-GUAGCCUGAUUGUGCAUUUCAAUGAAG-3'   (SEQ ID NO: 2374)
               3'-CAUCGGACUAACACGUAAAGUUACUUC-5'   (SEQ ID NO: 574)
MET-3488 Target: 5'-GTAGCCTGATTGTGCATTTCAATGAAG-3' (SEQ ID NO: 934)

5'-UAGCCUGAUUGUGCAUUUCAAUGAAGU-3'   (SEQ ID NO: 2375)
               3'-AUCGGACUAACACGUAAAGUUACUUCA-5'   (SEQ ID NO: 575)
MET-3489 Target: 5'-TAGCCTGATTGTGCATTTCAATGAAGT-3' (SEQ ID NO: 935)

5'-AGCCUGAUUGUGCAUUUCAAUGAAGUC-3'   (SEQ ID NO: 2376)
               3'-UCGGACUAACACGUAAAGUUACUUCAG-5'   (SEQ ID NO: 576)
MET-3490 Target: 5'-AGCCTGATTGTGCATTTCAATGAAGTC-3' (SEQ ID NO: 936)

5'-GCCUGAUUGUGCAUUUCAAUGAAGUCA-3'   (SEQ ID NO: 2377)
               3'-CGGACUAACACGUAAAGUUACUUCAGU-5'   (SEQ ID NO: 577)
MET-3491 Target: 5'-GCCTGATTGTGCATTTCAATGAAGTCA-3' (SEQ ID NO: 937)

5'-CCUGAUUGUGCAUUUCAAUGAAGUCAU-3'   (SEQ ID NO: 2378)
               3'-GGACUAACACGUAAAGUUACUUCAGUA-5'   (SEQ ID NO: 578)
MET-3492 Target: 5'-CCTGATTGTGCATTTCAATGAAGTCAT-3' (SEQ ID NO: 938)

5'-CUGAUUGUGCAUUUCAAUGAAGUCAUA-3'   (SEQ ID NO: 2379)
               3'-GACUAACACGUAAAGUUACUUCAGUAU-5'   (SEQ ID NO: 579)
MET-3493 Target: 5'-CTGATTGTGCATTTCAATGAAGTCATA-3' (SEQ ID NO: 939)

5'-UGAUUGUGCAUUUCAAUGAAGUCAUAG-3'   (SEQ ID NO: 2380)
               3'-ACUAACACGUAAAGUUACUUCAGUAUC-5'   (SEQ ID NO: 580)
MET-3494 Target: 5'-TGATTGTGCATTTCAATGAAGTCATAG-3' (SEQ ID NO: 940)

5'-GAUUGUGCAUUUCAAUGAAGUCAUAGG-3'   (SEQ ID NO: 2381)
               3'-CUAACACGUAAAGUUACUUCAGUAUCC-5'   (SEQ ID NO: 581)
MET-3495 Target: 5'-GATTGTGCATTTCAATGAAGTCATAGG-3' (SEQ ID NO: 941)

5'-AUUGUGCAUUUCAAUGAAGUCAUAGGA-3'   (SEQ ID NO: 2382)
               3'-UAACACGUAAAGUUACUUCAGUAUCCU-5'   (SEQ ID NO: 582)
MET-3496 Target: 5'-ATTGTGCATTTCAATGAAGTCATAGGA-3' (SEQ ID NO: 942)

5'-UUGUGCAUUUCAAUGAAGUCAUAGGAA-3'   (SEQ ID NO: 2383)
               3'-AACACGUAAAGUUACUUCAGUAUCCUU-5'   (SEQ ID NO: 583)
MET-3497 Target: 5'-TTGTGCATTTCAATGAAGTCATAGGAA-3' (SEQ ID NO: 943)

5'-UGUGCAUUUCAAUGAAGUCAUAGGAAG-3'   (SEQ ID NO: 2384)
               3'-ACACGUAAAGUUACUUCAGUAUCCUUC-5'   (SEQ ID NO: 584)
MET-3498 Target: 5'-TGTGCATTTCAATGAAGTCATAGGAAG-3' (SEQ ID NO: 944)
```

TABLE 9-continued

Selected Human Anti-MET "Blunt/Blunt" DsiRNAs

```
                5'-GUGCAUUUCAAUGAAGUCAUAGGAAGA-3'    (SEQ ID NO: 2385)
                3'-CACGUAAAGUUACUUCAGUAUCCUUCU-5'    (SEQ ID NO: 585)
MET-3499 Target: 5'-GTGCATTTCAATGAAGTCATAGGAAGA-3'   (SEQ ID NO: 945)

5'-UGCAUUUCAAUGAAGUCAUAGGAAGAG-3'    (SEQ ID NO: 2386)
                3'-ACGUAAAGUUACUUCAGUAUCCUUCUC-5'    (SEQ ID NO: 586)
MET-3500 Target: 5'-TGCATTTCAATGAAGTCATAGGAAGAG-3'   (SEQ ID NO: 946)

5'-GCAUUUCAAUGAAGUCAUAGGAAGAGG-3'    (SEQ ID NO: 2387)
                3'-CGUAAAGUUACUUCAGUAUCCUUCUCC-5'    (SEQ ID NO: 587)
MET-3501 Target: 5'-GCATTTCAATGAAGTCATAGGAAGAGG-3'   (SEQ ID NO: 947)

5'-CAUUUCAAUGAAGUCAUAGGAAGAGGG-3'    (SEQ ID NO: 2388)
                3'-GUAAAGUUACUUCAGUAUCCUUCUCCC-5'    (SEQ ID NO: 588)
MET-3502 Target: 5'-CATTTCAATGAAGTCATAGGAAGAGGG-3'   (SEQ ID NO: 948)

5'-AUUUCAAUGAAGUCAUAGGAAGAGGGC-3'    (SEQ ID NO: 2389)
                3'-UAAAGUUACUUCAGUAUCCUUCUCCCG-5'    (SEQ ID NO: 589)
MET-3503 Target: 5'-ATTTCAATGAAGTCATAGGAAGAGGGC-3'   (SEQ ID NO: 949)

5'-UUUCAAUGAAGUCAUAGGAAGAGGGCA-3'    (SEQ ID NO: 2390)
                3'-AAAGUUACUUCAGUAUCCUUCUCCCGU-5'    (SEQ ID NO: 590)
MET-3504 Target: 5'-TTTCAATGAAGTCATAGGAAGAGGGCA-3'   (SEQ ID NO: 950)

5'-UUCAAUGAAGUCAUAGGAAGAGGGCAU-3'    (SEQ ID NO: 2391)
                3'-AAGUUACUUCAGUAUCCUUCUCCCGUA-5'    (SEQ ID NO: 591)
MET-3505 Target: 5'-TTCAATGAAGTCATAGGAAGAGGGCAT-3'   (SEQ ID NO: 951)

5'-UCAAUGAAGUCAUAGGAAGAGGGCAUU-3'    (SEQ ID NO: 2392)
                3'-AGUUACUUCAGUAUCCUUCUCCCGUAA-5'    (SEQ ID NO: 592)
MET-3506 Target: 5'-TCAATGAAGTCATAGGAAGAGGGCATT-3'   (SEQ ID NO: 952)

5'-CAAUGAAGUCAUAGGAAGAGGGCAUUU-3'    (SEQ ID NO: 2393)
                3'-GUUACUUCAGUAUCCUUCUCCCGUAAA-5'    (SEQ ID NO: 593)
MET-3507 Target: 5'-CAATGAAGTCATAGGAAGAGGGCATTT-3'   (SEQ ID NO: 953)

5'-AAUGAAGUCAUAGGAAGAGGGCAUUUU-3'    (SEQ ID NO: 2394)
                3'-UUACUUCAGUAUCCUUCUCCCGUAAAA-5'    (SEQ ID NO: 594)
MET-3508 Target: 5'-AATGAAGTCATAGGAAGAGGGCATTTT-3'   (SEQ ID NO: 954)

5'-AUGAAGUCAUAGGAAGAGGGCAUUUUG-3'    (SEQ ID NO: 2395)
                3'-UACUUCAGUAUCCUUCUCCCGUAAAAC-5'    (SEQ ID NO: 595)
MET-3509 Target: 5'-ATGAAGTCATAGGAAGAGGGCATTTTG-3'   (SEQ ID NO: 955)

5'-UGAAGUCAUAGGAAGAGGGCAUUUUGG-3'    (SEQ ID NO: 2396)
                3'-ACUUCAGUAUCCUUCUCCCGUAAAACC-5'    (SEQ ID NO: 596)
MET-3510 Target: 5'-TGAAGTCATAGGAAGAGGGCATTTTGG-3'   (SEQ ID NO: 956)

5'-GAAGUCAUAGGAAGAGGGCAUUUUGGU-3'    (SEQ ID NO: 2397)
                3'-CUUCAGUAUCCUUCUCCCGUAAAACCA-5'    (SEQ ID NO: 597)
MET-3511 Target: 5'-GAAGTCATAGGAAGAGGGCATTTTGGT-3'   (SEQ ID NO: 957)

5'-AAGUCAUAGGAAGAGGGCAUUUUGGUU-3'    (SEQ ID NO: 2398)
                3'-UUCAGUAUCCUUCUCCCGUAAAACCAA-5'    (SEQ ID NO: 598)
MET-3512 Target: 5'-AAGTCATAGGAAGAGGGCATTTTGGTT-3'   (SEQ ID NO: 958)

5'-AGUCAUAGGAAGAGGGCAUUUUGGUUG-3'    (SEQ ID NO: 2399)
                3'-UCAGUAUCCUUCUCCCGUAAAACCAAC-5'    (SEQ ID NO: 599)
MET-3513 Target: 5'-AGTCATAGGAAGAGGGCATTTTGGTTG-3'   (SEQ ID NO: 959)

5'-GUCAUAGGAAGAGGGCAUUUUGGUUGU-3'    (SEQ ID NO: 2400)
                3'-CAGUAUCCUUCUCCCGUAAAACCAACA-5'    (SEQ ID NO: 600)
MET-3514 Target: 5'-GTCATAGGAAGAGGGCATTTTGGTTGT-3'   (SEQ ID NO: 960)

5'-UCAUAGGAAGAGGGCAUUUUGGUUGUG-3'    (SEQ ID NO: 2401)
                3'-AGUAUCCUUCUCCCGUAAAACCAACAC-5'    (SEQ ID NO: 601)
MET-3515 Target: 5'-TCATAGGAAGAGGGCATTTTGGTTGTG-3'   (SEQ ID NO: 961)

5'-GCAAGAAAAUUCACUGUGCUGUGAAAU-3'    (SEQ ID NO: 2402)
                3'-CGUUCUUUUAAGUGACACGACACUUUA-5'    (SEQ ID NO: 602)
MET-3572 Target: 5'-GCAAGAAAATTCACTGTGCTGTGAAAT-3'   (SEQ ID NO: 962)

5'-CAAGAAAAUUCACUGUGCUGUGAAAUC-3'    (SEQ ID NO: 2403)
                3'-GUUCUUUUAAGUGACACGACACUUUAG-5'    (SEQ ID NO: 603)
MET-3573 Target: 5'-CAAGAAAATTCACTGTGCTGTGAAATC-3'   (SEQ ID NO: 963)
```

TABLE 9-continued

Selected Human Anti-MET "Blunt/Blunt" DsiRNAs

```
                5'-AAGAAAAUUCACUGUGCUGUGAAAUCC-3'      (SEQ ID NO: 2404)
                3'-UUCUUUUAAGUGACACGACACUUUAGG-5'      (SEQ ID NO: 604)
MET-3574 Target: 5'-AAGAAAATTCACTGTGCTGTGAAATCC-3'      (SEQ ID NO: 964)

5'-AGAAAAUUCACUGUGCUGUGAAAUCCU-3'      (SEQ ID NO: 2405)
                3'-UCUUUUAAGUGACACGACACUUUAGGA-5'      (SEQ ID NO: 605)
MET-3575 Target: 5'-AGAAAATTCACTGTGCTGTGAAATCCT-3'      (SEQ ID NO: 965)

5'-GAAAAUUCACUGUGCUGUGAAAUCCUU-3'      (SEQ ID NO: 2406)
                3'-CUUUUAAGUGACACGACACUUUAGGAA-5'      (SEQ ID NO: 606)
MET-3576 Target: 5'-GAAAATTCACTGTGCTGTGAAATCCTT-3'      (SEQ ID NO: 966)

5'-AAAAUUCACUGUGCUGUGAAAUCCUUG-3'      (SEQ ID NO: 2407)
                3'-UUUUAAGUGACACGACACUUUAGGAAC-5'      (SEQ ID NO: 607)
MET-3577 Target: 5'-AAAATTCACTGTGCTGTGAAATCCTTG-3'      (SEQ ID NO: 967)

5'-AAAUUCACUGUGCUGUGAAAUCCUUGA-3'      (SEQ ID NO: 2408)
                3'-UUUAAGUGACACGACACUUUAGGAACU-5'      (SEQ ID NO: 608)
MET-3578 Target: 5'-AAATTCACTGTGCTGTGAAATCCTTGA-3'      (SEQ ID NO: 968)

5'-AAUUCACUGUGCUGUGAAAUCCUUGAA-3'      (SEQ ID NO: 2409)
                3'-UUAAGUGACACGACACUUUAGGAACUU-5'      (SEQ ID NO: 609)
MET-3579 Target: 5'-AATTCACTGTGCTGTGAAATCCTTGAA-3'      (SEQ ID NO: 969)

5'-AUUCACUGUGCUGUGAAAUCCUUGAAC-3'      (SEQ ID NO: 2410)
                3'-UAAGUGACACGACACUUUAGGAACUUG-5'      (SEQ ID NO: 610)
MET-3580 Target: 5'-ATTCACTGTGCTGTGAAATCCTTGAAC-3'      (SEQ ID NO: 970)

5'-UUCACUGUGCUGUGAAAUCCUUGAACA-3'      (SEQ ID NO: 2411)
                3'-AAGUGACACGACACUUUAGGAACUUGU-5'      (SEQ ID NO: 611)
MET-3581 Target: 5'-TTCACTGTGCTGTGAAATCCTTGAACA-3'      (SEQ ID NO: 971)

5'-UCACUGUGCUGUGAAAUCCUUGAACAG-3'      (SEQ ID NO: 2412)
                3'-AGUGACACGACACUUUAGGAACUUGUC-5'      (SEQ ID NO: 612)
MET-3582 Target: 5'-TCACTGTGCTGTGAAATCCTTGAACAG-3'      (SEQ ID NO: 972)

5'-CCGAGGGAAUCAUCAUGAAAGAUUUUA-3'      (SEQ ID NO: 2413)
                3'-GGCUCCCUUAGUAGUACUUUCUAAAAU-5'      (SEQ ID NO: 613)
MET-3644 Target: 5'-CCGAGGGAATCATCATGAAAGATTTTA-3'      (SEQ ID NO: 973)

5'-CGAGGGAAUCAUCAUGAAAGAUUUUAG-3'      (SEQ ID NO: 2414)
                3'-GCUCCCUUAGUAGUACUUUCUAAAAUC-5'      (SEQ ID NO: 614)
MET-3645 Target: 5'-CGAGGGAATCATCATGAAAGATTTTAG-3'      (SEQ ID NO: 974)

5'-AUGAGACUCAUAAUCCAACUGUAAAAG-3'      (SEQ ID NO: 2415)
                3'-UACUCUGAGUAUUAGGUUGACAUUUUC-5'      (SEQ ID NO: 615)
MET-3779 Target: 5'-ATGAGACTCATAATCCAACTGTAAAAG-3'      (SEQ ID NO: 975)

5'-UGAGACUCAUAAUCCAACUGUAAAAGA-3'      (SEQ ID NO: 2416)
                3'-ACUCUGAGUAUUAGGUUGACAUUUUCU-5'      (SEQ ID NO: 616)
MET-3780 Target: 5'-TGAGACTCATAATCCAACTGTAAAAGA-3'      (SEQ ID NO: 976)

5'-AACUGUAAAAGAUCUUAUUGGCUUUGG-3'      (SEQ ID NO: 2417)
                3'-UUGACAUUUUCUAGAAUAACCGAAACC-5'      (SEQ ID NO: 617)
MET-3795 Target: 5'-AACTGTAAAAGATCTTATTGGCTTTGG-3'      (SEQ ID NO: 977)

5'-UUGGCUUUGGUCUUCAAGUAGCCAAAG-3'      (SEQ ID NO: 2418)
                3'-AACCGAAACCAGAAGUUCAUCGGUUUC-5'      (SEQ ID NO: 618)
MET-3812 Target: 5'-TTGGCTTTGGTCTTCAAGTAGCCAAAG-3'      (SEQ ID NO: 978)

5'-GUCUUCAAGUAGCCAAAGGCAUGAAAU-3'      (SEQ ID NO: 2419)
                3'-CAGAAGUUCAUCGGUUUCCGUACUUUA-5'      (SEQ ID NO: 619)
MET-3821 Target: 5'-GTCTTCAAGTAGCCAAAGGCATGAAAT-3'      (SEQ ID NO: 979)

5'-UCUUCAAGUAGCCAAAGGCAUGAAAUA-3'      (SEQ ID NO: 2420)
                3'-AGAAGUUCAUCGGUUUCCGUACUUUAU-5'      (SEQ ID NO: 620)
MET-3822 Target: 5'-TCTTCAAGTAGCCAAAGGCATGAAATA-3'      (SEQ ID NO: 980)

5'-CUUCAAGUAGCCAAAGGCAUGAAAUAU-3'      (SEQ ID NO: 2421)
                3'-GAAGUUCAUCGGUUUCCGUACUUUAUA-5'      (SEQ ID NO: 621)
MET-3823 Target: 5'-CTTCAAGTAGCCAAAGGCATGAAATAT-3'      (SEQ ID NO: 981)

5'-UUCAAGUAGCCAAAGGCAUGAAAUAUC-3'      (SEQ ID NO: 2422)
                3'-AAGUUCAUCGGUUUCCGUACUUUAUAG-5'      (SEQ ID NO: 622)
MET-3824 Target: 5'-TTCAAGTAGCCAAAGGCATGAAATATC-3'      (SEQ ID NO: 982)
```

TABLE 9-continued

Selected Human Anti-MET "Blunt/Blunt" DsiRNAs

```
                5'-UCAAGUAGCCAAAGGCAUGAAAUAUCU-3'   (SEQ ID NO: 2423)
                3'-AGUUCAUCGGUUUCCGUACUUUAUAGA-5'   (SEQ ID NO: 623)
MET-3825 Target: 5'-TCAAGTAGCCAAAGGCATGAAATATCT-3'   (SEQ ID NO: 983)

5'-CAAGUAGCCAAAGGCAUGAAAUAUCUU-3'   (SEQ ID NO: 2424)
                3'-GUUCAUCGGUUUCCGUACUUUAUAGAA-5'   (SEQ ID NO: 624)
MET-3826 Target: 5'-CAAGTAGCCAAAGGCATGAAATATCTT-3'   (SEQ ID NO: 984)

5'-AAGUAGCCAAAGGCAUGAAAUAUCUUG-3'   (SEQ ID NO: 2425)
                3'-UUCAUCGGUUUCCGUACUUUAUAGAAC-5'   (SEQ ID NO: 625)
MET-3827 Target: 5'-AAGTAGCCAAAGGCATGAAATATCTTG-3'   (SEQ ID NO: 985)

5'-AGUAGCCAAAGGCAUGAAAUAUCUUGC-3'   (SEQ ID NO: 2426)
                3'-UCAUCGGUUUCCGUACUUUAUAGAACG-5'   (SEQ ID NO: 626)
MET-3828 Target: 5'-AGTAGCCAAAGGCATGAAATATCTTGC-3'   (SEQ ID NO: 986)

5'-GUAGCCAAAGGCAUGAAAUAUCUUGCA-3'   (SEQ ID NO: 2427)
                3'-CAUCGGUUUCCGUACUUUAUAGAACGU-5'   (SEQ ID NO: 627)
MET-3829 Target: 5'-GTAGCCAAAGGCATGAAATATCTTGCA-3'   (SEQ ID NO: 987)

5'-UAGCCAAAGGCAUGAAAUAUCUUGCAA-3'   (SEQ ID NO: 2428)
                3'-AUCGGUUUCCGUACUUUAUAGAACGUU-5'   (SEQ ID NO: 628)
MET-3830 Target: 5'-TAGCCAAAGGCATGAAATATCTTGCAA-3'   (SEQ ID NO: 988)

5'-AGCCAAAGGCAUGAAAUAUCUUGCAAG-3'   (SEQ ID NO: 2429)
                3'-UCGGUUUCCGUACUUUAUAGAACGUUC-5'   (SEQ ID NO: 629)
MET-3831 Target: 5'-AGCCAAAGGCATGAAATATCTTGCAAG-3'   (SEQ ID NO: 989)

5'-GCCAAAGGCAUGAAAUAUCUUGCAAGC-3'   (SEQ ID NO: 2430)
                3'-CGGUUUCCGUACUUUAUAGAACGUUCG-5'   (SEQ ID NO: 630)
MET-3832 Target: 5'-GCCAAAGGCATGAAATATCTTGCAAGC-3'   (SEQ ID NO: 990)

5'-CCAAAGGCAUGAAAUAUCUUGCAAGCA-3'   (SEQ ID NO: 2431)
                3'-GGUUUCCGUACUUUAUAGAACGUUCGU-5'   (SEQ ID NO: 631)
MET-3833 Target: 5'-CCAAAGGCATGAAATATCTTGCAAGCA-3'   (SEQ ID NO: 991)

5'-CAAAGGCAUGAAAUAUCUUGCAAGCAA-3'   (SEQ ID NO: 2432)
                3'-GUUUCCGUACUUUAUAGAACGUUCGUU-5'   (SEQ ID NO: 632)
MET-3834 Target: 5'-CAAAGGCATGAAATATCTTGCAAGCAA-3'   (SEQ ID NO: 992)

5'-CAAGCAAAAGUUUGUCCACAGAGACU-3'    (SEQ ID NO: 2433)
                3'-GUUCGUUUUCAAACAGGUGUCUCUGA-5'    (SEQ ID NO: 633)
MET-3854 Target: 5'-CAAGCAAAAGTTTGTCCACAGAGACT-3'    (SEQ ID NO: 993)

5'-AAGCAAAAGUUUGUCCACAGAGACUU-3'    (SEQ ID NO: 2434)
                3'-UUCGUUUUCAAACAGGUGUCUCUGAA-5'    (SEQ ID NO: 634)
MET-3855 Target: 5'-AAGCAAAAGTTTGTCCACAGAGACTT-3'    (SEQ ID NO: 994)

5'-AGCAAAAGUUUGUCCACAGAGACUUG-3'    (SEQ ID NO: 2435)
                3'-UCGUUUUCAAACAGGUGUCUCUGAAC-5'    (SEQ ID NO: 635)
MET-3856 Target: 5'-AGCAAAAGTTTGTCCACAGAGACTTG-3'    (SEQ ID NO: 995)

5'-GCAAAAGUUUGUCCACAGAGACUUGG-3'    (SEQ ID NO: 2436)
                3'-CGUUUUCAAACAGGUGUCUCUGAACC-5'    (SEQ ID NO: 636)
MET-3857 Target: 5'-GCAAAAGTTTGTCCACAGAGACTTGG-3'    (SEQ ID NO: 996)

5'-CAAAAGUUUGUCCACAGAGACUUGGC-3'    (SEQ ID NO: 2437)
                3'-GUUUUCAAACAGGUGUCUCUGAACCG-5'    (SEQ ID NO: 637)
MET-3858 Target: 5'-CAAAAGTTTGTCCACAGAGACTTGGC-3'    (SEQ ID NO: 997)

5'-AAAAGUUUGUCCACAGAGACUUGGCU-3'    (SEQ ID NO: 2438)
                3'-UUUUCAAACAGGUGUCUCUGAACCGA-5'    (SEQ ID NO: 638)
MET-3859 Target: 5'-AAAAGTTTGTCCACAGAGACTTGGCT-3'    (SEQ ID NO: 998)

5'-AAAGUUUGUCCACAGAGACUUGGCUG-3'    (SEQ ID NO: 2439)
                3'-UUUCAAACAGGUGUCUCUGAACCGAC-5'    (SEQ ID NO: 639)
MET-3860 Target: 5'-AAAGTTTGTCCACAGAGACTTGGCTG-3'    (SEQ ID NO: 999)

5'-AAGUUUGUCCACAGAGACUUGGCUGC-3'    (SEQ ID NO: 2440)
                3'-UUCAAACAGGUGUCUCUGAACCGACG-5'    (SEQ ID NO: 640)
MET-3861 Target: 5'-AAGTTTGTCCACAGAGACTTGGCTGC-3'    (SEQ ID NO: 1000)

5'-GACUUGGCUGCAAGAAACUGUAUGCUG-3'   (SEQ ID NO: 2441)
                3'-CUGAACCGACGUUCUUUGACAUACGAC-5'   (SEQ ID NO: 641)
MET-3877 Target: 5'-GACTTGGCTGCAAGAAACTGTATGCTG-3'   (SEQ ID NO: 1001)
```

TABLE 9-continued

Selected Human Anti-MET "Blunt/Blunt" DsiRNAs

```
            5'-CUUGGCUGCAAGAAACUGUAUGCUGGA-3'  (SEQ ID NO: 2442)
            3'-GAACCGACGUUCUUUGACAUACGACCU-5'  (SEQ ID NO: 642)
MET-3879 Target: 5'-CTTGGCTGCAAGAAACTGTATGCTGGA-3'  (SEQ ID NO: 1002)

5'-UUGGCUGCAAGAAACUGUAUGCUGGAU-3'  (SEQ ID NO: 2443)
            3'-AACCGACGUUCUUUGACAUACGACCUA-5'  (SEQ ID NO: 643)
MET-3880 Target: 5'-TTGGCTGCAAGAAACTGTATGCTGGAT-3'  (SEQ ID NO: 1003)

5'-UGGCUGCAAGAAACUGUAUGCUGGAUG-3'  (SEQ ID NO: 2444)
            3'-ACCGACGUUCUUUGACAUACGACCUAC-5'  (SEQ ID NO: 644)
MET-3881 Target: 5'-TGGCTGCAAGAAACTGTATGCTGGATG-3'  (SEQ ID NO: 1004)

5'-GGCUGCAAGAAACUGUAUGCUGGAUGA-3'  (SEQ ID NO: 2445)
            3'-CCGACGUUCUUUGACAUACGACCUACU-5'  (SEQ ID NO: 645)
MET-3882 Target: 5'-GGCTGCAAGAAACTGTATGCTGGATGA-3'  (SEQ ID NO: 1005)

5'-CAGUCAAGGUUGCUGAUUUUGGUCUUG-3'  (SEQ ID NO: 2446)
            3'-GUCAGUUCCAACGACUAAAACCAGAAC-5'  (SEQ ID NO: 646)
MET-3917 Target: 5'-CAGTCAAGGTTGCTGATTTTGGTCTTG-3'  (SEQ ID NO: 1006)

5'-AAGGUUGCUGAUUUUGGUCUUGCCAGA-3'  (SEQ ID NO: 2447)
            3'-UUCCAACGACUAAAACCAGAACGGUCU-5'  (SEQ ID NO: 647)
MET-3922 Target: 5'-AAGGTTGCTGATTTTGGTCTTGCCAGA-3'  (SEQ ID NO: 1007)

5'-GGUUGCUGAUUUUGGUCUUGCCAGAGA-3'  (SEQ ID NO: 2448)
            3'-CCAACGACUAAAACCAGAACGGUCUCU-5'  (SEQ ID NO: 648)
MET-3924 Target: 5'-GGTTGCTGATTTTGGTCTTGCCAGAGA-3'  (SEQ ID NO: 1008)

5'-UUGGUCUUGCCAGAGACAUGUAUGAUA-3'  (SEQ ID NO: 2449)
            3'-AACCAGAACGGUCUCUGUACAUACUAU-5'  (SEQ ID NO: 649)
MET-3935 Target: 5'-TTGGTCTTGCCAGAGACATGTATGATA-3'  (SEQ ID NO: 1009)

5'-UGGUCUUGCCAGAGACAUGUAUGAUAA-3'  (SEQ ID NO: 2450)
            3'-ACCAGAACGGUCUCUGUACAUACUAUU-5'  (SEQ ID NO: 650)
MET-3936 Target: 5'-TGGTCTTGCCAGAGACATGTATGATAA-3'  (SEQ ID NO: 1010)

5'-AAGCUGCCAGUGAAGUGGAUGGCUUUG-3'  (SEQ ID NO: 2451)
            3'-UUCGACGGUCACUUCACCUACCGAAAC-5'  (SEQ ID NO: 651)
MET-3997 Target: 5'-AAGCTGCCAGTGAAGTGGATGGCTTTG-3'  (SEQ ID NO: 1011)

5'-AGCUGCCAGUGAAGUGGAUGGCUUUGG-3'  (SEQ ID NO: 2452)
            3'-UCGACGGUCACUUCACCUACCGAAACC-5'  (SEQ ID NO: 652)
MET-3998 Target: 5'-AGCTGCCAGTGAAGTGGATGGCTTTGG-3'  (SEQ ID NO: 1012)

5'-AAGUGGAUGGCUUUGGAAAGUCUGCAA-3'  (SEQ ID NO: 2453)
            3'-UUCACCUACCGAAACCUUUCAGACGUU-5'  (SEQ ID NO: 653)
MET-4009 Target: 5'-AAGTGGATGGCTTTGGAAAGTCTGCAA-3'  (SEQ ID NO: 1013)

5'-GUGGAUGGCUUUGGAAAGUCUGCAAAC-3'  (SEQ ID NO: 2454)
            3'-CACCUACCGAAACCUUUCAGACGUUUG-5'  (SEQ ID NO: 654)
MET-4011 Target: 5'-GTGGATGGCTTTGGAAAGTCTGCAAAC-3'  (SEQ ID NO: 1014)

5'-GCUUUGGAAAGUCUGCAAACUCAAAAG-3'  (SEQ ID NO: 2455)
            3'-CGAAACCUUUCAGACGUUUGAGUUUUC-5'  (SEQ ID NO: 655)
MET-4018 Target: 5'-GCTTTGGAAAGTCTGCAAACTCAAAAG-3'  (SEQ ID NO: 1015)

5'-UCCUUUGGCGUGCUCCUCUGGGAGCUG-3'  (SEQ ID NO: 2456)
            3'-AGGAAACCGCACGAGGAGACCCUCGAC-5'  (SEQ ID NO: 656)
MET-4069 Target: 5'-TCCTTTGGCGTGCTCCTCTGGGAGCTG-3'  (SEQ ID NO: 1016)

5'-CUUUGGCGUGCUCCUCUGGGAGCUGAU-3'  (SEQ ID NO: 2457)
            3'-GAAACCGCACGAGGAGACCCUCGACUA-5'  (SEQ ID NO: 657)
MET-4071 Target: 5'-CTTTGGCGTGCTCCTCTGGGAGCTGAT-3'  (SEQ ID NO: 1017)

5'-UUUGGCGUGCUCCUCUGGGAGCUGAUG-3'  (SEQ ID NO: 2458)
            3'-AAACCGCACGAGGAGACCCUCGACUAC-5'  (SEQ ID NO: 658)
MET-4072 Target: 5'-TTTGGCGTGCTCCTCTGGGAGCTGATG-3'  (SEQ ID NO: 1018)

5'-UUGGCGUGCUCCUCUGGGAGCUGAUGA-3'  (SEQ ID NO: 2459)
            3'-AACCGCACGAGGAGACCCUCGACUACU-5'  (SEQ ID NO: 659)
MET-4073 Target: 5'-TTGGCGTGCTCCTCTGGGAGCTGATGA-3'  (SEQ ID NO: 1019)

5'-UGGCGUGCUCCUCUGGGAGCUGAUGAC-3'  (SEQ ID NO: 2460)
            3'-ACCGCACGAGGAGACCCUCGACUACUG-5'  (SEQ ID NO: 660)
MET-4074 Target: 5'-TGGCGTGCTCCTCTGGGAGCTGATGAC-3'  (SEQ ID NO: 1020)
```

TABLE 9-continued

Selected Human Anti-MET "Blunt/Blunt" DsiRNAs

```
            5'-AUGUGAACGCUACUUAUGUGAACGUAA-3'  (SEQ ID NO: 2461)
            3'-UACACUUGCGAUGAAUACACUUGCAUU-5'  (SEQ ID NO: 661)
MET-4319 Target: 5'-ATGTGAACGCTACTTATGTGAACGTAA-3'  (SEQ ID NO: 1021)

5'-UGUGAACGCUACUUAUGUGAACGUAAA-3'  (SEQ ID NO: 2462)
            3'-ACACUUGCGAUGAAUACACUUGCAUUU-5'  (SEQ ID NO: 662)
MET-4320 Target: 5'-TGTGAACGCTACTTATGTGAACGTAAA-3'  (SEQ ID NO: 1022)

5'-CUCUGUUGUCAUCAGAAGAUAACGCUG-3'  (SEQ ID NO: 2463)
            3'-GAGACAACAGUAGUCUUCUAUUGCGAC-5'  (SEQ ID NO: 663)
MET-4367 Target: 5'-CTCTGTTGTCATCAGAAGATAACGCTG-3'  (SEQ ID NO: 1023)

5'-CUUUGCUCUUGCCAAAAUUGCACUAUU-3'  (SEQ ID NO: 2464)
            3'-GAAACGAGAACGGUUUUAACGUGAUAA-5'  (SEQ ID NO: 664)
MET-4523 Target: 5'-CTTTGCTCTTGCCAAAATTGCACTATT-3'  (SEQ ID NO: 1024)

5'-GUAUUGUUAUUUAAAUUACUGGAUUCU-3'  (SEQ ID NO: 2465)
            3'-CAUAACAAUAAAUUUAAUGACCUAAGA-5'  (SEQ ID NO: 665)
MET-4559 Target: 5'-GTATTGTTATTTAAATTACTGGATTCT-3'  (SEQ ID NO: 1025)

5'-UACUGGAUUCUAAGGAAUUUCUUAUCU-3'  (SEQ ID NO: 2466)
            3'-AUGACCUAAGAUUCCUUAAAGAAUAGA-5'  (SEQ ID NO: 666)
MET-4575 Target: 5'-TACTGGATTCTAAGGAATTTCTTATCT-3'  (SEQ ID NO: 1026)

5'-ACUGGAUUCUAAGGAAUUUCUUAUCUG-3'  (SEQ ID NO: 2467)
            3'-UGACCUAAGAUUCCUUAAAGAAUAGAC-5'  (SEQ ID NO: 667)
MET-4576 Target: 5'-ACTGGATTCTAAGGAATTTCTTATCTG-3'  (SEQ ID NO: 1027)

5'-UGGGUUGAAUUUUUUAAAAAUCAGGUA-3'  (SEQ ID NO: 2468)
            3'-ACCCAACUUAAAAAAUUUUUAGUCCAU-5'  (SEQ ID NO: 668)
MET-4703 Target: 5'-TGGGTTGAATTTTTTAAAAATCAGGTA-3'  (SEQ ID NO: 1028)

5'-GUAAACAUUCCCUUUUAAAUGUUUGUU-3'  (SEQ ID NO: 2469)
            3'-CAUUUGUAAGGGAAAAUUUACAAACAA-5'  (SEQ ID NO: 669)
MET-4935 Target: 5'-GTAAACATTCCCTTTTAAATGTTTGTT-3'  (SEQ ID NO: 1029)

5'-UUUUAAAUGUUUGUUUGUUUUUUGAGA-3'  (SEQ ID NO: 2470)
            3'-AAAAUUUACAAACAAACAAAAAACUCU-5'  (SEQ ID NO: 670)
MET-4947 Target: 5'-TTTTAAATGTTTGTTTGTTTTTGAGA-3'  (SEQ ID NO: 1030)

5'-CAGGAUCUCACUCUGUUGCCAGGGCUG-3'  (SEQ ID NO: 2471)
            3'-GUCCUAGAGUGAGACAACGGUCCCGAC-5'  (SEQ ID NO: 671)
MET-4974 Target: 5'-CAGGATCTCACTCTGTTGCCAGGGCTG-3'  (SEQ ID NO: 1031)

5'-GGAUCUCACUCUGUUGCCAGGGCUGUA-3'  (SEQ ID NO: 2472)
            3'-CCUAGAGUGAGACAACGGUCCCGACAU-5'  (SEQ ID NO: 672)
MET-4976 Target: 5'-GGATCTCACTCTGTTGCCAGGGCTGTA-3'  (SEQ ID NO: 1032)

5'-CUCACUCUGUUGCCAGGGCUGUAGUGC-3'  (SEQ ID NO: 2473)
            3'-GAGUGAGACAACGGUCCCGACAUCACG-5'  (SEQ ID NO: 673)
MET-4980 Target: 5'-CTCACTCTGTTGCCAGGGCTGTAGTGC-3'  (SEQ ID NO: 1033)

5'-CACUCUGUUGCCAGGGCUGUAGUGCAG-3'  (SEQ ID NO: 2474)
            3'-GUGAGACAACGGUCCCGACAUCACGUC-5'  (SEQ ID NO: 674)
MET-4982 Target: 5'-CACTCTGTTGCCAGGGCTGTAGTGCAG-3'  (SEQ ID NO: 1034)

5'-CUGUUGCCAGGGCUGUAGUGCAGUGGU-3'  (SEQ ID NO: 2475)
            3'-GACAACGGUCCCGACAUCACGUCACCA-5'  (SEQ ID NO: 675)
MET-4986 Target: 5'-CTGTTGCCAGGGCTGTAGTGCAGTGGT-3'  (SEQ ID NO: 1035)

5'-GGCUGUAGUGCAGUGGUGUGAUCAUAG-3'  (SEQ ID NO: 2476)
            3'-CCGACAUCACGUCACCACACUAGUAUC-5'  (SEQ ID NO: 676)
MET-4996 Target: 5'-GGCTGTAGTGCAGTGGTGTGATCATAG-3'  (SEQ ID NO: 1036)

5'-GUGCAGUGGUGUGAUCAUAGCUCACUG-3'  (SEQ ID NO: 2477)
            3'-CACGUCACCACACUAGUAUCGAGUGAC-5'  (SEQ ID NO: 677)
MET-5003 Target: 5'-GTGCAGTGGTGTGATCATAGCTCACTG-3'  (SEQ ID NO: 1037)

5'-CCGGCUAAUUUUUGUAUUUUUUGUAGA-3'  (SEQ ID NO: 2478)
            3'-GGCCGAUUAAAAACAUAAAAAACAUCU-5'  (SEQ ID NO: 678)
MET-5094 Target: 5'-CCGGCTAATTTTTGTATTTTTTGTAGA-3'  (SEQ ID NO: 1038)

5'-CCUUAUAAAUUUUGUAUAGACAUUCC-3'  (SEQ ID NO: 2479)
            3'-GGAAUAUUUAAAAACAUAUCUGUAAGG-5'  (SEQ ID NO: 679)
MET-5234 Target: 5'-CCTTATAAATTTTTGTATAGACATTCC-3'  (SEQ ID NO: 1039)
```

TABLE 9-continued

Selected Human Anti-MET "Blunt/Blunt" DsiRNAs

```
                 5'-GUUGGAAGAAUAUUUAUAGGCAAUACA-3'  (SEQ ID NO: 2480)
                 3'-CAACCUUCUUAUAAAUAUCCGUUAUGU-5'  (SEQ ID NO: 680)
MET-5265 Target: 5'-GTTGGAAGAATATTTATAGGCAATACA-3'  (SEQ ID NO: 1040)

5'-CACACAAAACAUGUUUAUAAAUGAACA-3'  (SEQ ID NO: 2481)
                 3'-GUGUGUUUUGUACAAAUAUUUACUUGU-5'  (SEQ ID NO: 681)
MET-5313 Target: 5'-CACACAAAACATGTTTATAAATGAACA-3'  (SEQ ID NO: 1041)

5'-AUGACAUUAAGAAAAUUUGUAUGAAAU-3'  (SEQ ID NO: 2482)
                 3'-UACUGUAAUUCUUUUAAACAUACUUUA-5'  (SEQ ID NO: 682)
MET-5357 Target: 5'-ATGACATTAAGAAAATTTGTATGAAAT-3'  (SEQ ID NO: 1042)

5'-UUGUGUGUAUUUUUUUAAAUGAAAACU-3'  (SEQ ID NO: 2483)
                 3'-AACACACAUAAAAAAAUUUACUUUUGA-5'  (SEQ ID NO: 683)
MET-5479 Target: 5'-TTGTGTGTATTTTTTTAAATGAAAACT-3'  (SEQ ID NO: 1043)

5'-AACUCAGCAUGUUUGUAAAGCAGGAUA-3'  (SEQ ID NO: 2484)
                 3'-UUGAGUCGUACAAACAUUUCGUCCUAU-5'  (SEQ ID NO: 684)
MET-5548 Target: 5'-AACTCAGCATGTTTGTAAAGCAGGATA-3'  (SEQ ID NO: 1044)

5'-UGGAUGGAUUGAAAAGAUUAGCCUCUG-3'  (SEQ ID NO: 2485)
                 3'-ACCUACCUAACUUUUCUAAUCGGAGAC-5'  (SEQ ID NO: 685)
MET-5634 Target: 5'-TGGATGGATTGAAAAGATTAGCCTCTG-3'  (SEQ ID NO: 1045)

5'-AUUCUGUGGAAUUUUGUGCUUGCUACU-3'  (SEQ ID NO: 2486)
                 3'-UAAGACACCUUAAAACACGAACGAUGA-5'  (SEQ ID NO: 686)
MET-5847 Target: 5'-ATTCTGTGGAATTTTGTGCTTGCTACT-3'  (SEQ ID NO: 1046)

5'-UUCUGUGGAAUUUUGUGCUUGCUACUG-3'  (SEQ ID NO: 2487)
                 3'-AAGACACCUUAAAACACGAACGAUGAC-5'  (SEQ ID NO: 687)
MET-5848 Target: 5'-TTCTGTGGAATTTTGTGCTTGCTACTG-3'  (SEQ ID NO: 1047)

5'-CUGUGGAAUUUUGUGCUUGCUACUGUA-3'  (SEQ ID NO: 2488)
                 3'-GACACCUUAAAACACGAACGAUGACAU-5'  (SEQ ID NO: 688)
MET-5850 Target: 5'-CTGTGGAATTTTGTGCTTGCTACTGTA-3'  (SEQ ID NO: 1048)

5'-UGGAAUUUUGUGCUUGCUACUGUAUAG-3'  (SEQ ID NO: 2489)
                 3'-ACCUUAAAACACGAACGAUGACAUAUC-5'  (SEQ ID NO: 689)
MET-5853 Target: 5'-TGGAATTTTGTGCTTGCTACTGTATAG-3'  (SEQ ID NO: 1049)

5'-AAUUUUGUGCUUGCUACUGUAUAGUGC-3'  (SEQ ID NO: 2490)
                 3'-UUAAAACACGAACGAUGACAUAUCACG-5'  (SEQ ID NO: 690)
MET-5856 Target: 5'-AATTTTGTGCTTGCTACTGTATAGTGC-3'  (SEQ ID NO: 1050)

5'-UUUUGUGCUUGCUACUGUAUAGUGCAU-3'  (SEQ ID NO: 2491)
                 3'-AAAACACGAACGAUGACAUAUCACGUA-5'  (SEQ ID NO: 691)
MET-5858 Target: 5'-TTTTGTGCTTGCTACTGTATAGTGCAT-3'  (SEQ ID NO: 1051)

5'-UUUGUGCUUGCUACUGUAUAGUGCAUG-3'  (SEQ ID NO: 2492)
                 3'-AAACACGAACGAUGACAUAUCACGUAC-5'  (SEQ ID NO: 692)
MET-5859 Target: 5'-TTTGTGCTTGCTACTGTATAGTGCATG-3'  (SEQ ID NO: 1052)

5'-UUGUGCUUGCUACUGUAUAGUGCAUGU-3'  (SEQ ID NO: 2493)
                 3'-AACACGAACGAUGACAUAUCACGUACA-5'  (SEQ ID NO: 693)
MET-5860 Target: 5'-TTGTGCTTGCTACTGTATAGTGCATGT-3'  (SEQ ID NO: 1053)

5'-UGUGCUUGCUACUGUAUAGUGCAUGUG-3'  (SEQ ID NO: 2494)
                 3'-ACACGAACGAUGACAUAUCACGUACAC-5'  (SEQ ID NO: 694)
MET-5861 Target: 5'-TGTGCTTGCTACTGTATAGTGCATGTG-3'  (SEQ ID NO: 1054)

5'-GUGCUUGCUACUGUAUAGUGCAUGUGG-3'  (SEQ ID NO: 2495)
                 3'-CACGAACGAUGACAUAUCACGUACACC-5'  (SEQ ID NO: 695)
MET-5862 Target: 5'-GTGCTTGCTACTGTATAGTGCATGTGG-3'  (SEQ ID NO: 1055)

5'-GCUUGCUACUGUAUAGUGCAUGUGGUG-3'  (SEQ ID NO: 2496)
                 3'-CGAACGAUGACAUAUCACGUACACCAC-5'  (SEQ ID NO: 696)
MET-5864 Target: 5'-GCTTGCTACTGTATAGTGCATGTGGTG-3'  (SEQ ID NO: 1056)

5'-UUGCUACUGUAUAGUGCAUGUGGUGUA-3'  (SEQ ID NO: 2497)
                 3'-AACGAUGACAUAUCACGUACACCACAU-5'  (SEQ ID NO: 697)
MET-5866 Target: 5'-TTGCTACTGTATAGTGCATGTGGTGTA-3'  (SEQ ID NO: 1057)

5'-UGCUACUGUAUAGUGCAUGUGGUGUAG-3'  (SEQ ID NO: 2498)
                 3'-ACGAUGACAUAUCACGUACACCACAUC-5'  (SEQ ID NO: 698)
MET-5867 Target: 5'-TGCTACTGTATAGTGCATGTGGTGTAG-3'  (SEQ ID NO: 1058)
```

TABLE 9-continued

Selected Human Anti-MET "Blunt/Blunt" DsiRNAs

```
            5'-GCUACUGUAUAGUGCAUGUGGUGUAGG-3'   (SEQ ID NO: 2499)
            3'-CGAUGACAUAUCACGUACACCACAUCC-5'   (SEQ ID NO: 699)
MET-5868 Target: 5'-GCTACTGTATAGTGCATGTGGTGTAGG-3'  (SEQ ID NO: 1059)

5'-UAAACAUUUAAAGUGUUAUAUUUUUUA-3'   (SEQ ID NO: 2500)
            3'-AUUUGUAAAUUUCACAAUAUAAAAAAU-5'   (SEQ ID NO: 700)
MET-5919 Target: 5'-TAAACATTTAAAGTGTTATATTTTTTA-3'  (SEQ ID NO: 1060)

5'-UAAAAAUGUUUAUUUUUAAUGAUAUGA-3'   (SEQ ID NO: 2501)
            3'-AUUUUUACAAAUAAAAAUUACUAUACU-5'   (SEQ ID NO: 701)
MET-5946 Target: 5'-TAAAAATGTTTATTTTTAATGATATGA-3'  (SEQ ID NO: 1061)

5'-AAAAAUGUUUAUUUUUAAUGAUAUGAG-3'   (SEQ ID NO: 2502)
            3'-UUUUUACAAAUAAAAAUUACUAUACUC-5'   (SEQ ID NO: 702)
MET-5947 Target: 5'-AAAAATGTTTATTTTTAATGATATGAG-3'  (SEQ ID NO: 1062)

5'-AAAAUGUUUAUUUUUAAUGAUAUGAGA-3'   (SEQ ID NO: 2503)
            3'-UUUUACAAAUAAAAAUUACUAUACUCU-5'   (SEQ ID NO: 703)
MET-5948 Target: 5'-AAAATGTTTATTTTTAATGATATGAGA-3'  (SEQ ID NO: 1063)

5'-GCACUGUGAACAUUUUAGAAAAGGUAU-3'   (SEQ ID NO: 2504)
            3'-CGUGACACUUGUAAAAUCUUUUCCAUA-5'   (SEQ ID NO: 704)
MET-6002 Target: 5'-GCACTGTGAACATTTTAGAAAAGGTAT-3'  (SEQ ID NO: 1064)

5'-GCGAUAAGGAAAUGUACUGAUUGCCAA-3'   (SEQ ID NO: 2505)
            3'-CGCUAUUCCUUUACAUGACUAACGGUU-5'   (SEQ ID NO: 705)
MET-6075 Target: 5'-GCGATAAGGAAATGTACTGATTGCCAA-3'  (SEQ ID NO: 1065)

5'-CGAUAAGGAAAUGUACUGAUUGCCAAU-3'   (SEQ ID NO: 2506)
            3'-GCUAUUCCUUUACAUGACUAACGGUUA-5'   (SEQ ID NO: 706)
MET-6076 Target: 5'-CGATAAGGAAATGTACTGATTGCCAAT-3'  (SEQ ID NO: 1066)

5'-GAUAAGGAAAUGUACUGAUUGCCAAUA-3'   (SEQ ID NO: 2507)
            3'-CUAUUCCUUUACAUGACUAACGGUUAU-5'   (SEQ ID NO: 707)
MET-6077 Target: 5'-GATAAGGAAATGTACTGATTGCCAATA-3'  (SEQ ID NO: 1067)

5'-AUAAGGAAAUGUACUGAUUGCCAAUAC-3'   (SEQ ID NO: 2508)
            3'-UAUUCCUUUACAUGACUAACGGUUAUG-5'   (SEQ ID NO: 708)
MET-6078 Target: 5'-ATAAGGAAATGTACTGATTGCCAATAC-3'  (SEQ ID NO: 1068)

5'-UAAGGAAAUGUACUGAUUGCCAAUACA-3'   (SEQ ID NO: 2509)
            3'-AUUCCUUUACAUGACUAACGGUUAUGU-5'   (SEQ ID NO: 709)
MET-6079 Target: 5'-TAAGGAAATGTACTGATTGCCAATACA-3'  (SEQ ID NO: 1069)

5'-AAGGAAAUGUACUGAUUGCCAAUACAC-3'   (SEQ ID NO: 2510)
            3'-UUCCUUUACAUGACUAACGGUUAUGUG-5'   (SEQ ID NO: 710)
MET-6080 Target: 5'-AAGGAAATGTACTGATTGCCAATACAC-3'  (SEQ ID NO: 1070)

5'-AUCAGGACUUGAAGCCAAGGGUUAACC-3'   (SEQ ID NO: 2511)
            3'-UAGUCCUGAACUUCGGUUCCCAAUUGG-5'   (SEQ ID NO: 711)
MET-6124 Target: 5'-ATCAGGACTTGAAGCCAAGGGTTAACC-3'  (SEQ ID NO: 1071)

5'-UCAGGACUUGAAGCCAAGGGUUAACCC-3'   (SEQ ID NO: 2512)
            3'-AGUCCUGAACUUCGGUUCCCAAUUGGG-5'   (SEQ ID NO: 712)
MET-6125 Target: 5'-TCAGGACTTGAAGCCAAGGGTTAACCC-3'  (SEQ ID NO: 1072)

5'-CAGGACUUGAAGCCAAGGGUUAACCCA-3'   (SEQ ID NO: 2513)
            3'-GUCCUGAACUUCGGUUCCCAAUUGGGU-5'   (SEQ ID NO: 713)
MET-6126 Target: 5'-CAGGACTTGAAGCCAAGGGTTAACCCA-3'  (SEQ ID NO: 1073)

5'-AGGACUUGAAGCCAAGGGUUAACCCAG-3'   (SEQ ID NO: 2514)
            3'-UCCUGAACUUCGGUUCCCAAUUGGGUC-5'   (SEQ ID NO: 714)
MET-6127 Target: 5'-AGGACTTGAAGCCAAGGGTTAACCCAG-3'  (SEQ ID NO: 1074)

5'-GGACUUGAAGCCAAGGGUUAACCCAGC-3'   (SEQ ID NO: 2515)
            3'-CCUGAACUUCGGUUCCCAAUUGGGUCG-5'   (SEQ ID NO: 715)
MET-6128 Target: 5'-GGACTTGAAGCCAAGGGTTAACCCAGC-3'  (SEQ ID NO: 1075)

5'-UGCCGUUUCAUAAAUGUAAUAAGUAAU-3'   (SEQ ID NO: 2516)
            3'-ACGGCAAAGUAUUUACAUUAUUCAUUA-5'   (SEQ ID NO: 716)
MET-6307 Target: 5'-TGCCGTTTCATAAATGTAATAAGTAAT-3'  (SEQ ID NO: 1076)

5'-UUUGCUAUUUAUAAACUUGUCCUUAGA-3'   (SEQ ID NO: 2517)
            3'-AAACGAUAAAUAUUUGAACAGGAAUCU-5'   (SEQ ID NO: 717)
MET-6520 Target: 5'-TTTGCTATTTATAAACTTGTCCTTAGA-3'  (SEQ ID NO: 1077)
```

TABLE 9-continued

Selected Human Anti-MET "Blunt/Blunt" DsiRNAs

```
            5'-ACUUGUCACUGCCUAUACCUGCAGCUG-3'  (SEQ ID NO: 2518)
            3'-UGAACAGUGACGGAUAUGGACGUCGAC-5'  (SEQ ID NO: 718)
MET-6599 Target: 5'-ACTTGTCACTGCCTATACCTGCAGCTG-3'  (SEQ ID NO: 1078)

5'-CUUGUCACUGCCUAUACCUGCAGCUGA-3'  (SEQ ID NO: 2519)
            3'-GAACAGUGACGGAUAUGGACGUCGACU-5'  (SEQ ID NO: 719)
MET-6600 Target: 5'-CTTGTCACTGCCTATACCTGCAGCTGA-3'  (SEQ ID NO: 1079)

5'-UUGUCACUGCCUAUACCUGCAGCUGAA-3'  (SEQ ID NO: 2520)
            3'-AACAGUGACGGAUAUGGACGUCGACUU-5'  (SEQ ID NO: 720)
MET-6601 Target: 5'-TTGTCACTGCCTATACCTGCAGCTGAA-3'  (SEQ ID NO: 1080)
```

TABLE 10

Selected Mouse Anti-MET "Blunt/Blunt" DsiRNAs

```
            5'-CGGCCUCGCCGCCCGCAGCGUCCGAGC-3'  (SEQ ID NO: 2953)
            3'-GCCGGAGCGGCGGGCGUCGCAGGCUCG-5'  (SEQ ID NO: 2593)
MET-m65 Target:  5'-CGGCCTCGCCGCCCGCAGCGTCCGAGC-3'  (SEQ ID NO: 2665)

5'-CUGUGCGGAGCCAGAUGCUGGGCGACC-3'  (SEQ ID NO: 2954)
            3'-GACACGCCUCGGUCUACGACCCGCUGG-5'  (SEQ ID NO: 2594)
MET-m102 Target: 5'-CTGTGCGGAGCCAGATGCTGGGCGACC-3'  (SEQ ID NO: 2666)

5'-GCGGAGCCAGAUGCUGGGCGACCGCUG-3'  (SEQ ID NO: 2955)
            3'-CGCCUCGGUCUACGACCCGCUGGCGAC-5'  (SEQ ID NO: 2595)
MET-m106 Target: 5'-GCGGAGCCAGATGCTGGGCGACCGCTG-3'  (SEQ ID NO: 2667)

5'-AGAUGCUGGGCGACCGCUGACUCGCUG-3'  (SEQ ID NO: 2956)
            3'-UCUACGACCCGCUGGCGACUGAGCGAC-5'  (SEQ ID NO: 2596)
MET-m114 Target: 5'-AGATGCTGGGCGACCGCTGACTCGCTG-3'  (SEQ ID NO: 2668)

5'-GAUGCUGGGCGACCGCUGACUCGCUGG-3'  (SEQ ID NO: 2957)
            3'-CUACGACCCGCUGGCGACUGAGCGACC-5'  (SEQ ID NO: 2597)
MET-m115 Target: 5'-GATGCTGGGCGACCGCTGACTCGCTGG-3'  (SEQ ID NO: 2669)

5'-UGCUGGGCGACCGCUGACUCGCUGGAG-3'  (SEQ ID NO: 2958)
            3'-ACGACCCGCUGGCGACUGAGCGACCUC-5'  (SEQ ID NO: 2598)
MET-m117 Target: 5'-TGCTGGGCGACCGCTGACTCGCTGGAG-3'  (SEQ ID NO: 2670)

5'-CCCAGCCGGCUGACUUCGGCGCCGCGC-3'  (SEQ ID NO: 2959)
            3'-GGGUCGGCCGACUGAAGCCGCGGCGCG-5'  (SEQ ID NO: 2599)
MET-m167 Target: 5'-CCCAGCCGGCTGACTTCGGCGCCGCGC-3'  (SEQ ID NO: 2671)

5'-CAGCCGGCUGACUUCGGCGCCGCGCGC-3'  (SEQ ID NO: 2960)
            3'-GUCGGCCGACUGAAGCCGCGGCGCGCG-5'  (SEQ ID NO: 2600)
MET-m169 Target: 5'-CAGCCGGCTGACTTCGGCGCCGCGCGC-3'  (SEQ ID NO: 2672)

5'-GCCGGCUGACUUCGGCGCCGCGCGCUC-3'  (SEQ ID NO: 2961)
            3'-CGGCCGACUGAAGCCGCGGCGCGCGAG-5'  (SEQ ID NO: 2601)
MET-m171 Target: 5'-GCCGGCTGACTTCGGCGCCGCGCGCTC-3'  (SEQ ID NO: 2673)

5'-AAGCUGACGGUGUAGCAGAACGCUUGG-3'  (SEQ ID NO: 2962)
            3'-UUCGACUGCCACAUCGUCUUGCGAACC-5'  (SEQ ID NO: 2602)
MET-m335 Target: 5'-AAGCTGACGGTGTAGCAGAACGCTTGG-3'  (SEQ ID NO: 2674)

5'-AGCUGACGGUGUAGCAGAACGCUUGGC-3'  (SEQ ID NO: 2963)
            3'-UCGACUGCCACAUCGUCUUGCGAACCG-5'  (SEQ ID NO: 2603)
MET-m336 Target: 5'-AGCTGACGGTGTAGCAGAACGCTTGGC-3'  (SEQ ID NO: 2675)

5'-CUGGCACCUGGCAUUCUGGUGCUGCUG-3'  (SEQ ID NO: 2964)
            3'-GACCGUGGACCGUAAGACCACGACGAC-5'  (SEQ ID NO: 2604)
MET-m400 Target: 5'-CTGGCACCTGGCATTCTGGTGCTGCTG-3'  (SEQ ID NO: 2676)

5'-GGCACCUGGCAUUCUGGUGCUGCUGUU-3'  (SEQ ID NO: 2965)
            3'-CCGUGGACCGUAAGACCACGACGACAA-5'  (SEQ ID NO: 2605)
MET-m402 Target: 5'-GGCACCTGGCATTCTGGTGCTGCTGTT-3'  (SEQ ID NO: 2677)

5'-GCACCUGGCAUUCUGGUGCUGCUGUUG-3'  (SEQ ID NO: 2966)
            3'-CGUGGACCGUAAGACCACGACGACAAC-5'  (SEQ ID NO: 2606)
MET-m403 Target: 5'-GCACCTGGCATTCTGGTGCTGCTGTTG-3'  (SEQ ID NO: 2678)
```

TABLE 10-continued

Selected Mouse Anti-MET "Blunt/Blunt" DsiRNAs

```
                5'-UUCUGGUGCUGCUGUUGUCCUUGGUGC-3'     (SEQ ID NO: 2967)
                3'-AAGACCACGACGACAACAGGAACCACG-5'     (SEQ ID NO: 2607)
MET-m413 Target: 5'-TTCTGGTGCTGCTGTTGTCCTTGGTGC-3'    (SEQ ID NO: 2679)

5'-CUGGUGCUGCUGUUGUCCUUGGUGCAG-3'    (SEQ ID NO: 2968)
                3'-GACCACGACGACAACAGGAACCACGUC-5'    (SEQ ID NO: 2608)
MET-m415 Target: 5'-CTGGTGCTGCTGTTGTCCTTGGTGCAG-3'   (SEQ ID NO: 2680)

5'-UGGUGCUGCUGUUGUCCUUGGUGCAGA-3'    (SEQ ID NO: 2969)
                3'-ACCACGACGACAACAGGAACCACGUCU-5'    (SEQ ID NO: 2609)
MET-m416 Target: 5'-TGGTGCTGCTGTTGTCCTTGGTGCAGA-3'   (SEQ ID NO: 2681)

5'-UGCUGCUGUUGUCCUUGGUGCAGAGGA-3'    (SEQ ID NO: 2970)
                3'-ACGACGACAACAGGAACCACGUCUCCU-5'    (SEQ ID NO: 2610)
MET-m419 Target: 5'-TGCTGCTGTTGTCCTTGGTGCAGAGGA-3'   (SEQ ID NO: 2682)

5'-CUGUUCCGUAGACUCUGGGUUGCACUC-3'   (SEQ ID NO: 2971)
                 3'-GACAAGGCAUCUGAGACCCAACGUGAG-5'   (SEQ ID NO: 2611)
MET-m1221 Target: 5'-CTGTTCCGTAGACTCTGGGTTGCACTC-3'  (SEQ ID NO: 2683)

5'-GAGCACUGUUUCAAUAGGACCCUGCUG-3'   (SEQ ID NO: 2972)
                 3'-CUCGUGACAAAGUUAUCCUGGGACGAC-5'   (SEQ ID NO: 2612)
MET-m1561 Target: 5'-GAGCACTGTTTCAATAGGACCCTGCTG-3'  (SEQ ID NO: 2684)

5'-AAACUCUUCCGGCUGUGAAGCGCGCAG-3'   (SEQ ID NO: 2973)
                 3'-UUUGAGAAGGCCGACACUUCGCGCGUC-5'   (SEQ ID NO: 2613)
MET-m1590 Target: 5'-AAACTCTTCCGGCTGTGAAGCGCGCAG-3'  (SEQ ID NO: 2685)

5'-ACUCUUCCGGCUGUGAAGCGCGCAGUG-3'   (SEQ ID NO: 2974)
                 3'-UGAGAAGGCCGACACUUCGCGCGUCAC-5'   (SEQ ID NO: 2614)
MET-m1592 Target: 5'-ACTCTTCCGGCTGTGAAGCGCGCAGTG-3'  (SEQ ID NO: 2686)

5'-UUUACCACGGCUUUGCAGCGCGUCGAC-3'   (SEQ ID NO: 2975)
                 3'-AAAUGGUGCCGAAACGUCGCGCAGCUG-5'   (SEQ ID NO: 2615)
MET-m1636 Target: 5'-TTTACCACGGCTTTGCAGCGCGTCGAC-3'  (SEQ ID NO: 2687)

5'-UACCACGGCUUUGCAGCGCGUCGACUU-3'   (SEQ ID NO: 2976)
                 3'-AUGGUGCCGAAACGUCGCGCAGCUGAA-5'   (SEQ ID NO: 2616)
MET-m1638 Target: 5'-TACCACGGCTTTGCAGCGCGTCGACTT-3'  (SEQ ID NO: 2688)

5'-CACGGCUUUGCAGCGCGUCGACUUAUU-3'   (SEQ ID NO: 2977)
                 3'-GUGCCGAAACGUCGCGCAGCUGAAUAA-5'   (SEQ ID NO: 2617)
MET-m1641 Target: 5'-CACGGCTTTGCAGCGCGTCGACTTATT-3'  (SEQ ID NO: 2689)

5'-CGGCUUUGCAGCGCGUCGACUUAUUCA-3'   (SEQ ID NO: 2978)
                 3'-GCCGAAACGUCGCGCAGCUGAAUAAGU-5'   (SEQ ID NO: 2618)
MET-m1643 Target: 5'-CGGCTTTGCAGCGCGTCGACTTATTCA-3'  (SEQ ID NO: 2690)

5'-GGCUUUGCAGCGCGUCGACUUAUUCAU-3'   (SEQ ID NO: 2979)
                 3'-CCGAAACGUCGCGCAGCUGAAUAAGUA-5'   (SEQ ID NO: 2619)
MET-m1644 Target: 5'-GGCTTTGCAGCGCGTCGACTTATTCAT-3'  (SEQ ID NO: 2691)

5'-GCUUUGCAGCGCGUCGACUUAUUCAUG-3'   (SEQ ID NO: 2980)
                 3'-CGAAACGUCGCGCAGCUGAAUAAGUAC-5'   (SEQ ID NO: 2620)
MET-m1645 Target: 5'-GCTTTGCAGCGCGTCGACTTATTCATG-3'  (SEQ ID NO: 2692)

5'-CUUUGCAGCGCGUCGACUUAUUCAUGG-3'   (SEQ ID NO: 2981)
                 3'-GAAACGUCGCGCAGCUGAAUAAGUACC-5'   (SEQ ID NO: 2621)
MET-m1646 Target: 5'-CTTTGCAGCGCGTCGACTTATTCATGG-3'  (SEQ ID NO: 2693)

5'-GCGCGUCGACUUAUUCAUGGGCCGGCU-3'   (SEQ ID NO: 2982)
                 3'-CGCGCAGCUGAAUAAGUACCCGGCCGA-5'   (SEQ ID NO: 2622)
MET-m1653 Target: 5'-GCGCGTCGACTTATTCATGGGCCGGCT-3'  (SEQ ID NO: 2694)

5'-GUCGCUUCAUGCAGGUGGUGCUCUCUC-3'   (SEQ ID NO: 2983)
                 3'-CAGCGAAGUACGUCCACCACGAGAGAG-5'   (SEQ ID NO: 2623)
MET-m1757 Target: 5'-GTCGCTTCATGCAGGTGGTGCTCTCTC-3'  (SEQ ID NO: 2695)

5'-AGGUGGUGCUCUCUCGAACAGCACACC-3'   (SEQ ID NO: 2984)
                 3'-UCCACCACGAGAGAGCUUGUCGUGUGG-5'   (SEQ ID NO: 2624)
MET-m1769 Target: 5'-AGGTGGTGCTCTCTCGAACAGCACACC-3'  (SEQ ID NO: 2696)

5'-GUGGUGCUCUCUCGAACAGCACACCUC-3'   (SEQ ID NO: 2985)
                 3'-CACCACGAGAGAGCUUGUCGUGUGGAG-5'   (SEQ ID NO: 2625)
MET-m1771 Target: 5'-GTGGTGCTCTCTCGAACAGCACACCTC-3'  (SEQ ID NO: 2697)
```

TABLE 10-continued

Selected Mouse Anti-MET "Blunt/Blunt" DsiRNAs

|  |  |  |  |
|---|---|---|---|
|  | 5'-CUGCUUGGCAACGAGAGCUGUACCUUG-3' | (SEQ ID NO: 2986) |  |
|  | 3'-GACGAACCGUUGCUCUCGACAUGGAAC-5' | (SEQ ID NO: 2626) |  |
| MET-m2188 Target: | 5'-CTGCTTGGCAACGAGAGCTGTACCTTG-3' | (SEQ ID NO: 2698) |  |
|  | 5'-UGCACUACUCCUUCACUGAAACAGCUG-3' | (SEQ ID NO: 2987) |  |
|  | 3'-ACGUGAUGAGGAAGUGACUUUGUCGAC-5' | (SEQ ID NO: 2627) |  |
| MET-m2779 Target: | 5'-TGCACTACTCCTTCACTGAAACAGCTG-3' | (SEQ ID NO: 2699) |  |
|  | 5'-AGCAAGCAGUCUCUUCAACUGUUCUUG-3' | (SEQ ID NO: 2988) |  |
|  | 3'-UCGUUCGUCAGAGAAGUUGACAAGAAC-5' | (SEQ ID NO: 2628) |  |
| MET-m3113 Target: | 5'-AGCAAGCAGTCTCTTCAACTGTTCTTG-3' | (SEQ ID NO: 2700) |  |
|  | 5'-GCAAGCAGUCUCUUCAACUGUUCUUGG-3' | (SEQ ID NO: 2989) |  |
|  | 3'-CGUUCGUCAGAGAAGUUGACAAGAACC-5' | (SEQ ID NO: 2629) |  |
| MET-m3114 Target: | 5'-GCAAGCAGTCTCTTCAACTGTTCTTGG-3' | (SEQ ID NO: 2701) |  |
|  | 5'-CAGUCUCUUCAACUGUUCUUGGAAAAG-3' | (SEQ ID NO: 2990) |  |
|  | 3'-GUCAGAGAAGUUGACAAGAACCUUUUC-5' | (SEQ ID NO: 2630) |  |
| MET-m3119 Target: | 5'-CAGTCTCTTCAACTGTTCTTGGAAAAG-3' | (SEQ ID NO: 2702) |  |
|  | 5'-UCAGCACGUAGUGAUUGGACCCAGCAG-3' | (SEQ ID NO: 2991) |  |
|  | 3'-AGUCGUGCAUCACUAACCUGGGUCGUC-5' | (SEQ ID NO: 2631) |  |
| MET-m3573 Target: | 5'-TCAGCACGTAGTGATTGGACCCAGCAG-3' | (SEQ ID NO: 2703) |  |
|  | 5'-UGGACCCAGCAGCCUGAUUGUGCAUUU-3' | (SEQ ID NO: 2992) |  |
|  | 3'-ACCUGGGUCGUCGGACUAACACGUAAA-5' | (SEQ ID NO: 2632) |  |
| MET-m3588 Target: | 5'-TGGACCCAGCAGCCTGATTGTGCATTT-3' | (SEQ ID NO: 2704) |  |
|  | 5'-CUGUCAAGGUUGCUGAUUUCGGUCUUG-3' | (SEQ ID NO: 2993) |  |
|  | 3'-GACAGUUCCAACGACUAAAGCCAGAAC-5' | (SEQ ID NO: 2633) |  |
| MET-m4025 Target: | 5'-CTGTCAAGGTTGCTGATTTCGGTCTTG-3' | (SEQ ID NO: 2705) |  |
|  | 5'-GGUUGCUGAUUUCGGUCUUGCCAGAGA-3' | (SEQ ID NO: 2994) |  |
|  | 3'-CCAACGACUAAAGCCAGAACGGUCUCU-5' | (SEQ ID NO: 2634) |  |
| MET-m4032 Target: | 5'-GGTTGCTGATTTCGGTCTTGCCAGAGA-3' | (SEQ ID NO: 2706) |  |
|  | 5'-GUGCCAAGCUACCAGUAAAGUGGAUGG-3' | (SEQ ID NO: 2995) |  |
|  | 3'-CACGGUUCGAUGGUCAUUUCACCUACC-5' | (SEQ ID NO: 2635) |  |
| MET-m4100 Target: | 5'-GTGCCAAGCTACCAGTAAAGTGGATGG-3' | (SEQ ID NO: 2707) |  |
|  | 5'-CAAGCUACCAGUAAAGUGGAUGGCUUU-3' | (SEQ ID NO: 2996) |  |
|  | 3'-GUUCGAUGGUCAUUUCACCUACCGAAA-5' | (SEQ ID NO: 2636) |  |
| MET-m4104 Target: | 5'-CAAGCTACCAGTAAAGTGGATGGCTTT-3' | (SEQ ID NO: 2708) |  |
|  | 5'-AAGCUACCAGUAAAGUGGAUGGCUUUA-3' | (SEQ ID NO: 2997) |  |
|  | 3'-UUCGAUGGUCAUUUCACCUACCGAAAU-5' | (SEQ ID NO: 2637) |  |
| MET-m4105 Target: | 5'-AAGCTACCAGTAAAGTGGATGGCTTTA-3' | (SEQ ID NO: 2709) |  |
|  | 5'-CUUUGGUGUGCUCCUCUGGGAGCUCAU-3' | (SEQ ID NO: 2998) |  |
|  | 3'-GAAACCACACGAGGAGACCCUCGAGUA-5' | (SEQ ID NO: 2638) |  |
| MET-m4179 Target: | 5'-CTTTGGTGTGCTCCTCTGGGAGCTCAT-3' | (SEQ ID NO: 2710) |  |
|  | 5'-UUUGGUGUGCUCCUCUGGGAGCUCAUG-3' | (SEQ ID NO: 2999) |  |
|  | 3'-AAACCACACGAGGAGACCCUCGAGUAC-5' | (SEQ ID NO: 2639) |  |
| MET-m4180 Target: | 5'-TTTGGTGTGCTCCTCTGGGAGCTCATG-3' | (SEQ ID NO: 2711) |  |
|  | 5'-UGGUGUGCUCCUCUGGGAGCUCAUGAC-3' | (SEQ ID NO: 3000) |  |
|  | 3'-ACCACACGAGGAGACCCUCGAGUACUG-5' | (SEQ ID NO: 2640) |  |
| MET-m4182 Target: | 5'-TGGTGTGCTCCTCTGGGAGCTCATGAC-3' | (SEQ ID NO: 2712) |  |
|  | 5'-UUUUGUUUUGUUUUUGUUUUGCUUUU-3' | (SEQ ID NO: 3001) |  |
|  | 3'-AAAACAAAACAAAAAACAAAACGAAAA-5' | (SEQ ID NO: 2641) |  |
| MET-m4639 Target: | 5'-TTTTGTTTTGTTTTTGTTTTGCTTTT-3' | (SEQ ID NO: 2713) |  |
|  | 5'-UUUGUUUUGUUUUUGUUUUGCUUUUG-3' | (SEQ ID NO: 3002) |  |
|  | 3'-AAACAAAACAAAAAACAAAACGAAAAC-5' | (SEQ ID NO: 2642) |  |
| MET-m4640 Target: | 5'-TTTGTTTTGTTTTTGTTTTGCTTTTG-3' | (SEQ ID NO: 2714) |  |
|  | 5'-UUGUUUUGUUUUUGUUUUGCUUUUGC-3' | (SEQ ID NO: 3003) |  |
|  | 3'-AACAAAACAAAAAACAAAACGAAAACG-5' | (SEQ ID NO: 2643) |  |
| MET-m4641 Target: | 5'-TTGTTTTGTTTTTGTTTTGCTTTTGC-3' | (SEQ ID NO: 2715) |  |
|  | 5'-UGUUUUGUUUUUGUUUUGCUUUUGCG-3' | (SEQ ID NO: 3004) |  |
|  | 3'-ACAAAACAAAAAACAAAACGAAAACGC-5' | (SEQ ID NO: 2644) |  |
| MET-m4642 Target: | 5'-TGTTTTGTTTTTGTTTTGCTTTTGCG-3' | (SEQ ID NO: 2716) |  |

TABLE 10-continued

Selected Mouse Anti-MET "Blunt/Blunt" DsiRNAs

|  |  |  |  |
|---|---|---|---|
| MET-m4643 | Target: | 5'-GUUUUGUUUUUGUUUUGCUUUUGCGG-3'<br>3'-CAAAACAAAAACAAAACGAAAACGCC-5'<br>5'-GTTTTGTTTTTGTTTTGCTTTTGCGG-3' | (SEQ ID NO: 3005)<br>(SEQ ID NO: 2645)<br>(SEQ ID NO: 2717) |
| MET-m4645 | Target: | 5'-UUUGUUUUUGUUUUGCUUUUGCGGUA-3'<br>3'-AAACAAAAAACAAAACGAAAACGCCAU-5'<br>5'-TTTGTTTTTGTTTTGCTTTTGCGGTA-3' | (SEQ ID NO: 3006)<br>(SEQ ID NO: 2646)<br>(SEQ ID NO: 2718) |
| MET-m4646 | Target: | 5'-UUGUUUUUGUUUUGCUUUUGCGGUAA-3'<br>3'-AACAAAAAACAAAACGAAAACGCCAUU-5'<br>5'-TTGTTTTTGTTTTGCTTTTGCGGTAA-3' | (SEQ ID NO: 3007)<br>(SEQ ID NO: 2647)<br>(SEQ ID NO: 2719) |
| MET-m4647 | Target: | 5'-UGUUUUUGUUUUGCUUUUGCGGUAAC-3'<br>3'-ACAAAAAACAAAACGAAAACGCCAUUG-5'<br>5'-TGTTTTTGTTTTGCTTTTGCGGTAAC-3' | (SEQ ID NO: 3008)<br>(SEQ ID NO: 2648)<br>(SEQ ID NO: 2720) |
| MET-m4648 | Target: | 5'-GUUUUUGUUUUGCUUUUGCGGUAACU-3'<br>3'-CAAAAAACAAAACGAAAACGCCAUUGA-5'<br>5'-GTTTTTGTTTTGCTTTTGCGGTAACT-3' | (SEQ ID NO: 3009)<br>(SEQ ID NO: 2649)<br>(SEQ ID NO: 2721) |
| MET-m4649 | Target: | 5'-UUUUUGUUUUGCUUUUGCGGUAACUG-3'<br>3'-AAAAAACAAAACGAAAACGCCAUUGAC-5'<br>5'-TTTTTGTTTTGCTTTTGCGGTAACTG-3' | (SEQ ID NO: 3010)<br>(SEQ ID NO: 2650)<br>(SEQ ID NO: 2722) |
| MET-m4650 | Target: | 5'-UUUUGUUUUGCUUUUGCGGUAACUGC-3'<br>3'-AAAAACAAAACGAAAACGCCAUUGACG-5'<br>5'-TTTTTGTTTTGCTTTTGCGGTAACTGC-3' | (SEQ ID NO: 3011)<br>(SEQ ID NO: 2651)<br>(SEQ ID NO: 2723) |
| MET-m4651 | Target: | 5'-UUUGUUUUGCUUUUGCGGUAACUGCA-3'<br>3'-AAAACAAAACGAAAACGCCAUUGACGU-5'<br>5'-TTTTGTTTTGCTTTTGCGGTAACTGCA-3' | (SEQ ID NO: 3012)<br>(SEQ ID NO: 2652)<br>(SEQ ID NO: 2724) |
| MET-m4652 | Target: | 5'-UUUGUUUUGCUUUUGCGGUAACUGCAC-3'<br>3'-AAACAAAACGAAAACGCCAUUGACGUG-5'<br>5'-TTTGTTTTGCTTTTGCGGTAACTGCAC-3' | (SEQ ID NO: 3013)<br>(SEQ ID NO: 2653)<br>(SEQ ID NO: 2725) |
| MET-m4653 | Target: | 5'-UUGUUUUGCUUUUGCGGUAACUGCACC-3'<br>3'-AACAAAACGAAAACGCCAUUGACGUGG-5'<br>5'-TTGTTTTGCTTTTGCGGTAACTGCACC-3' | (SEQ ID NO: 3014)<br>(SEQ ID NO: 2654)<br>(SEQ ID NO: 2726) |
| MET-m4654 | Target: | 5'-UGUUUUGCUUUUGCGGUAACUGCACCA-3'<br>3'-ACAAAACGAAAACGCCAUUGACGUGGU-5'<br>5'-TGTTTTGCTTTTGCGGTAACTGCACCA-3' | (SEQ ID NO: 3015)<br>(SEQ ID NO: 2655)<br>(SEQ ID NO: 2727) |
| MET-m4655 | Target: | 5'-GUUUUGCUUUUGCGGUAACUGCACCAC-3'<br>3'-CAAAACGAAAACGCCAUUGACGUGGUG-5'<br>5'-GTTTTGCTTTTGCGGTAACTGCACCAC-3' | (SEQ ID NO: 3016)<br>(SEQ ID NO: 2656)<br>(SEQ ID NO: 2728) |
| MET-m4656 | Target: | 5'-UUUUGCUUUUGCGGUAACUGCACCACU-3'<br>3'-AAAACGAAAACGCCAUUGACGUGGUGA-5'<br>5'-TTTTGCTTTTGCGGTAACTGCACCACT-3' | (SEQ ID NO: 3017)<br>(SEQ ID NO: 2657)<br>(SEQ ID NO: 2729) |
| MET-m4659 | Target: | 5'-UGCUUUUGCGGUAACUGCACCACUAUG-3'<br>3'-ACGAAAACGCCAUUGACGUGGUGAUAC-5'<br>5'-TGCTTTTGCGGTAACTGCACCACTATG-3' | (SEQ ID NO: 3018)<br>(SEQ ID NO: 2658)<br>(SEQ ID NO: 2730) |
| MET-m5255 | Target: | 5'-AACCCAGCUGUUUAGCAAGGAGUGUUG-3'<br>3'-UUGGGUCGACAAAUCGUUCCUCACAAC-5'<br>5'-AACCCAGCTGTTTAGCAAGGAGTGTTG-3' | (SEQ ID NO: 3019)<br>(SEQ ID NO: 2659)<br>(SEQ ID NO: 2731) |
| MET-m5259 | Target: | 5'-CAGCUGUUUAGCAAGGAGUGUUGGCUC-3'<br>3'-GUCGACAAAUCGUUCCUCACAACCGAG-5'<br>5'-CAGCTGTTTAGCAAGGAGTGTTGGCTC-3' | (SEQ ID NO: 3020)<br>(SEQ ID NO: 2660)<br>(SEQ ID NO: 2732) |
| MET-m5835 | Target: | 5'-UUUUGUGCUUACUACUGUAUAGUGCAU-3'<br>3'-AAAACACGAAUGAUGACAUAUCACGUA-5'<br>5'-TTTTGTGCTTACTACTGTATAGTGCAT-3' | (SEQ ID NO: 3021)<br>(SEQ ID NO: 2661)<br>(SEQ ID NO: 2733) |
| MET-m5836 | Target: | 5'-UUUGUGCUUACUACUGUAUAGUGCAUG-3'<br>3'-AAACACGAAUGAUGACAUAUCACGUAC-5'<br>5'-TTTGTGCTTACTACTGTATAGTGCATG-3' | (SEQ ID NO: 3022)<br>(SEQ ID NO: 2662)<br>(SEQ ID NO: 2734) |
| MET-m5837 | Target: | 5'-UUGUGCUUACUACUGUAUAGUGCAUGU-3'<br>3'-AACACGAAUGAUGACAUAUCACGUACA-5'<br>5'-TTGTGCTTACTACTGTATAGTGCATGT-3' | (SEQ ID NO: 3023)<br>(SEQ ID NO: 2663)<br>(SEQ ID NO: 2735) |

TABLE 10-continued

Selected Mouse Anti-MET "Blunt/Blunt" DsiRNAs

```
              5'-GUGCUUACUACUGUAUAGUGCAUGUGG-3'   (SEQ ID NO: 3024)
              3'-CACGAAUGAUGACAUAUCACGUACACC-5'   (SEQ ID NO: 2664)
MET-m5839 Target: 5'-GTGCTTACTACTGTATAGTGCATGTGG-3'  (SEQ ID NO: 2736)
```

Within Tables 2-5 and 7-10 above, underlined residues indicate 2'-O-methyl residues, UPPER CASE indicates ribonucleotides, and lower case denotes deoxyribonucleotides. The DsiRNA agents of Tables 2-5 above are 25/27mer agents possessing a blunt end. The structures and/or modification patterning of the agents of Tables 2-5 and 7-10 above can be readily adapted to the above generic sequence structures, e.g., the 3' overhang of the second strand can be extended or contracted, 2'-O-methylation of the second strand can be expanded towards the 5' end of the second strand, optionally at alternating sites, etc. Such further modifications are optional, as 25/27mer DsiRNAs with such modifications can also be readily designed from the above DsiRNA agents and are also expected to be functional inhibitors of MET expression. Similarly, the 27mer "blunt/fray" and "blunt/blunt" DsiRNA structures and/or modification patterns of the agents of Tables 7-10 above can also be readily adapted to the above generic sequence structures, e.g., for application of modification patterning of the antisense strand to such structures and/or adaptation of such sequences to the above generic structures.

In certain embodiments, 27mer DsiRNAs possessing independent strand lengths each of 27 nucleotides are designed and synthesized for targeting of the same sites within the MET transcript as the asymmetric "25/27" structures shown in Tables 2-3 herein. Exemplary "27/27" DsiRNAs are optionally designed with a "blunt/fray" structure as shown for the DsiRNAs of Tables 7-8 above, or with a "blunt/blunt" structure as shown for the DsiRNAs of Tables 9-10 above.

In certain embodiments, the dsRNA agents of the invention require, e.g., at least 19, at least 20, at least 21, at least 22, at least 23, at least 24, at least 25 or at least 26 residues of the first strand to be complementary to corresponding residues of the second strand. In certain related embodiments, these first strand residues complementary to corresponding residues of the second strand are optionally consecutive residues.

By definition, "sufficiently complementary" (contrasted with, e.g., "100% complementary") allows for one or more mismatches to exist between a dsRNA of the invention and the target RNA or cDNA sequence (e.g., MET mRNA), provided that the dsRNA possesses complementarity sufficient to trigger the destruction of the target RNA by the RNAi machinery (e.g., the RISC complex) or process. In certain embodiments, a "sufficiently complementary" dsRNA of the invention can harbor one, two, three or even four or more mismatches between the dsRNA sequence and the target RNA or cDNA sequence (e.g., in certain such embodiments, the antisense strand of the dsRNA harbors one, two, three, four, five or even six or more mismatches when aligned with the target RNA or cDNA sequence). Additional consideration of the preferred location of such mismatches within certain dsRNAs of the instant invention is considered in greater detail below.

As used herein "DsiRNAmm" refers to a DisRNA having a "mismatch tolerant region" containing one, two, three or four mismatched base pairs of the duplex formed by the sense and antisense strands of the DsiRNA, where such mismatches are positioned within the DsiRNA at a location(s) lying between (and thus not including) the two terminal base pairs of either end of the DsiRNA. The mismatched base pairs are located within a "mismatch-tolerant region" which is defined herein with respect to the location of the projected Ago2 cut site of the corresponding target nucleic acid. The mismatch tolerant region is located "upstream of" the projected Ago2 cut site of the target strand. "Upstream" in this context will be understood as the 5'-most portion of the DsiRNAmm duplex, where 5' refers to the orientation of the sense strand of the DsiRNA duplex. Therefore, the mismatch tolerant region is upstream of the base on the sense (passenger) strand that corresponds to the projected Ago2 cut site of the target nucleic acid (see FIG. 1); alternatively, when referring to the antisense (guide) strand of the DsiRNAmm, the mismatch tolerant region can also be described as positioned downstream of the base that is complementary to the projected Ago2 cut site of the target nucleic acid, that is, the 3'-most portion of the antisense strand of the DsiRNAmm (where position 1 of the antisense strand is the 5' terminal nucleotide of the antisense strand, see FIG. 1).

In one embodiment, for example with numbering as depicted in FIG. 1, the mismatch tolerant region is positioned between and including base pairs 3-9 when numbered from the nucleotide starting at the 5' end of the sense strand of the duplex. Therefore, a DsiRNAmm of the invention possesses a single mismatched base pair at any one of positions 3, 4, 5, 6, 7, 8 or 9 of the sense strand of a right-hand extended DsiRNA (where position 1 is the 5' terminal nucleotide of the sense strand and position 9 is the nucleotide residue of the sense strand that is immediately 5' of the projected Ago2 cut site of the target MET RNA sequence corresponding to the sense strand sequence). In certain embodiments, for a DsiRNAmm that possesses a mismatched base pair nucleotide at any of positions 3, 4, 5, 6, 7, 8 or 9 of the sense strand, the corresponding mismatched base pair nucleotide of the antisense strand not only forms a mismatched base pair with the DsiRNAmm sense strand sequence, but also forms a mismatched base pair with a DsiRNAmm target MET RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target MET RNA sequence). In alternative embodiments, the mismatch base pair nucleotide of the antisense strand of a DsiRNAmm only form a mismatched base pair with a corresponding nucleotide of the sense strand sequence of the DsiRNAmm, yet base pairs with its corresponding target MET RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target MET RNA sequence).

A DsiRNAmm of the invention that possesses a single mismatched base pair within the mismatch-tolerant region (mismatch region) as described above (e.g., a DsiRNAmm harboring a mismatched nucleotide residue at any one of positions 3, 4, 5, 6, 7, 8 or 9 of the sense strand) can further include one, two or even three additional mismatched base pairs. In preferred embodiments, these one, two or three additional mismatched base pairs of the DsiRNAmm occur at position(s) 3, 4, 5, 6, 7, 8 and/or 9 of the sense strand (and at corresponding residues of the antisense strand). In one embodiment where one additional mismatched base pair is present within a DsiRNAmm, the two mismatched base pairs of the sense strand can occur, e.g., at nucleotides of both position 4 and position 6 of the sense strand (with mismatch also occurring at corresponding nucleotide residues of the antisense strand).

In DsiRNAmm agents possessing two mismatched base pairs, mismatches can occur consecutively (e.g., at consecutive positions along the sense strand nucleotide sequence). Alternatively, nucleotides of the sense strand that form mismatched base pairs with the antisense strand sequence can be interspersed by nucleotides that base pair with the antisense strand sequence (e.g., for a DsiRNAmm possessing mismatched nucleotides at positions 3 and 6, but not at positions 4 and 5, the mismatched residues of sense strand positions 3 and 6 are interspersed by two nucleotides that form matched base pairs with corresponding residues of the antisense strand). For example, two residues of the sense strand (located within the mismatch-tolerant region of the sense strand) that form mismatched base pairs with the corresponding antisense strand sequence can occur with zero, one, two, three, four or five matched base pairs located between these mismatched base pairs.

For certain DsiRNAmm agents possessing three mismatched base pairs, mismatches can occur consecutively (e.g., in a triplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 4 and 8, but not at positions 5, 6 and 7, the mismatched residues of sense strand positions 3 and 4 are adjacent to one another, while the mismatched residues of sense strand positions 4 and 8 are interspersed by three nucleotides that form matched base pairs with corresponding residues of the antisense strand). For example, three residues of the sense strand (located within the mismatch-tolerant region of the sense strand) that form mismatched base pairs with the corresponding antisense strand sequence can occur with zero, one, two, three or four matched base pairs located between any two of these mismatched base pairs.

For certain DsiRNAmm agents possessing four mismatched base pairs, mismatches can occur consecutively (e.g., in a quadruplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 5, 7 and 8, but not at positions 4 and 6, the mismatched residues of sense strand positions 7 and 8 are adjacent to one another, while the mismatched residues of sense strand positions 3 and 5 are interspersed by one nucleotide that forms a matched base pair with the corresponding residue of the antisense strand—similarly, the mismatched residues of sense strand positions 5 and 7 are also interspersed by one nucleotide that forms a matched base pair with the corresponding residue of the antisense strand). For example, four residues of the sense strand (located within the mismatch-tolerant region of the sense strand) that form mismatched base pairs with the corresponding antisense strand sequence can occur with zero, one, two or three matched base pairs located between any two of these mismatched base pairs.

In another embodiment, for example with numbering also as depicted in FIG. 1, a DsiRNAmm of the invention comprises a mismatch tolerant region which possesses a single mismatched base pair nucleotide at any one of positions 17, 18, 19, 20, 21, 22 or 23 of the antisense strand of the DsiRNA (where position 1 is the 5' terminal nucleotide of the antisense strand and position 17 is the nucleotide residue of the antisense strand that is immediately 3' (downstream) in the antisense strand of the projected Ago2 cut site of the target MET RNA sequence sufficiently complementary to the antisense strand sequence). In certain embodiments, for a DsiRNAmm that possesses a mismatched base pair nucleotide at any of positions 17, 18, 19, 20, 21, 22 or 23 of the antisense strand with respect to the sense strand of the DsiRNAmm, the mismatched base pair nucleotide of the antisense strand not only forms a mismatched base pair with the DsiRNAmm sense strand sequence, but also forms a mismatched base pair with a DsiRNAmm target MET RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target MET RNA sequence). In alternative embodiments, the mismatch base pair nucleotide of the antisense strand of a DsiRNAmm only forms a mismatched base pair with a corresponding nucleotide of the sense strand sequence of the DsiRNAmm, yet base pairs with its corresponding target MET RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target MET RNA sequence).

A DsiRNAmm of the invention that possesses a single mismatched base pair within the mismatch-tolerant region as described above (e.g., a DsiRNAmm harboring a mismatched nucleotide residue at positions 17, 18, 19, 20, 21, 22 or 23 of the antisense strand) can further include one, two or even three additional mismatched base pairs. In preferred embodiments, these one, two or three additional mismatched base pairs of the DsiRNAmm occur at position(s) 17, 18, 19, 20, 21, 22 and/or 23 of the antisense strand (and at corresponding residues of the sense strand). In one embodiment where one additional mismatched base pair is present within a DsiRNAmm, the two mismatched base pairs of the antisense strand can occur, e.g., at nucleotides of both position 18 and position 20 of the antisense strand (with mismatch also occurring at corresponding nucleotide residues of the sense strand).

In DsiRNAmm agents possessing two mismatched base pairs, mismatches can occur consecutively (e.g., at consecutive positions along the antisense strand nucleotide sequence). Alternatively, nucleotides of the antisense strand that form mismatched base pairs with the sense strand sequence can be interspersed by nucleotides that base pair with the sense strand sequence (e.g., for a DsiRNAmm possessing mismatched nucleotides at positions 17 and 20, but not at positions 18 and 19, the mismatched residues of antisense strand positions 17 and 20 are interspersed by two nucleotides that form matched base pairs with corresponding residues of the sense strand). For example, two residues of the antisense strand (located within the mismatch-tolerant region of the sense strand) that form mismatched base pairs with the corresponding sense strand sequence can occur with zero, one, two, three, four, five, six or seven matched base pairs located between these mismatched base pairs.

For certain DsiRNAmm agents possessing three mismatched base pairs, mismatches can occur consecutively (e.g., in a triplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 17, 18 and 22, but not at positions 19, 20 and 21, the mismatched residues of antisense strand positions 17 and 18 are adjacent to one another, while the mismatched residues of antisense strand positions 18 and 122 are interspersed by three nucleotides that form matched base pairs with corresponding residues of the sense strand). For example, three residues of the antisense strand (located within the mismatch-tolerant region of the antisense strand) that form mismatched base pairs with the corresponding sense strand sequence can occur with zero, one, two, three, four, five or six matched base pairs located between any two of these mismatched base pairs.

For certain DsiRNAmm agents possessing four mismatched base pairs, mismatches can occur consecutively (e.g., in a quadruplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 18, 20, 22 and 23, but not at positions 19 and 21, the mismatched residues of antisense strand positions 22 and 23 are adjacent to one another, while the mismatched residues of antisense strand positions 18 and 20 are interspersed by one nucleotide that forms a matched base pair with the corresponding residue of the sense strand—similarly, the mismatched residues of antisense strand positions 20 and 22 are also interspersed by one nucleotide that forms a matched base pair with the corresponding residue of the sense strand). For example, four residues of the antisense strand (located within the mismatch-tolerant region of the antisense strand) that form mismatched base pairs with the corresponding sense strand sequence can occur with zero, one, two, three, four or five matched base pairs located between any two of these mismatched base pairs.

For reasons of clarity, the location(s) of mismatched nucleotide residues within the above DsiRNAmm agents are numbered in reference to the 5' terminal residue of either sense or antisense strands of the DsiRNAmm. The numbering of positions located within the mismatch-tolerant region (mismatch region) of the antisense strand can shift with variations in the proximity of the 5' terminus of the sense or antisense strand to the projected Ago2 cleavage site. Thus, the location(s) of preferred mismatch sites within either antisense strand or sense strand can also be identified as the permissible proximity of such mismatches to the projected Ago2 cut site. Accordingly, in one preferred embodiment, the position of a mismatch nucleotide of the sense strand of a DsiRNAmm is the nucleotide residue of the sense strand that is located immediately 5' (upstream) of the projected Ago2 cleavage site of the corresponding target MET RNA sequence. In other preferred embodiments, a mismatch nucleotide of the sense strand of a DsiRNAmm is positioned at the nucleotide residue of the sense strand that is located two nucleotides 5' (upstream) of the projected Ago2 cleavage site, three nucleotides 5' (upstream) of the projected Ago2 cleavage site, four nucleotides 5' (upstream) of the projected Ago2 cleavage site, five nucleotides 5' (upstream) of the projected Ago2 cleavage site, six nucleotides 5' (upstream) of the projected Ago2 cleavage site, seven nucleotides 5' (upstream) of the projected Ago2 cleavage site, eight nucleotides 5' (upstream) of the projected Ago2 cleavage site, or nine nucleotides 5' (upstream) of the projected Ago2 cleavage site.

Exemplary single mismatch-containing 25/27mer DsiRNAs (DsiRNAmm) include the following structures (such mismatch-containing structures may also be incorporated into other exemplary DsiRNA structures shown herein).

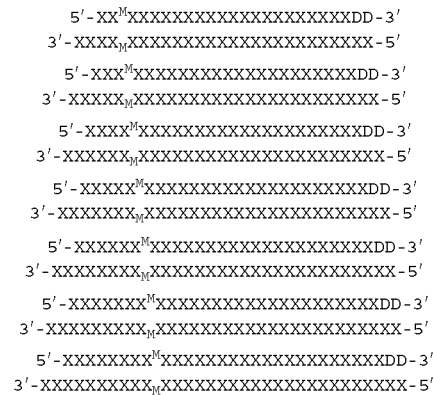

wherein "X"=RNA, "D"=DNA and "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNAmm agents. For the above mismatch structures, the top strand is the sense strand, and the bottom strand is the antisense strand.

In certain embodiments, a DsiRNA of the invention can contain mismatches that exist in reference to the target MET RNA sequence yet do not necessarily exist as mismatched base pairs within the two strands of the DsiRNA—thus, a DsiRNA can possess perfect complementarity between first and second strands of a DsiRNA, yet still possess mismatched residues in reference to a target MET RNA (which, in certain embodiments, may be advantageous in promoting efficacy and/or potency and/or duration of effect). In certain embodiments, where mismatches occur between antisense strand and target MET RNA sequence, the position of a mismatch is located within the antisense strand at a position(s) that corresponds to a sequence of the sense strand located 5' of the projected Ago2 cut site of the target region—e.g., antisense strand residue(s) positioned within the antisense strand to the 3' of the antisense residue which is complementary to the projected Ago2 cut site of the target sequence.

Exemplary 25/27mer DsiRNAs that harbor a single mismatched residue in reference to target sequences include the following structures.

```
Target RNA Sequence:       5'-...AXXXXXXXXXXXXXXXXXXXX...-3'
DsiRNAmm Sense Strand:     5'-XXXXXXXXXXXXXXXXXXXXXXXDD-3'
DsiRNAmm Antisense Strand: 3'-EXXXXXXXXXXXXXXXXXXXXXXXXX-5'

Target RNA Sequence:       5'-...XAXXXXXXXXXXXXXXXXXXX...-3'
DsiRNAmm Sense Strand:     5'-XXXXXXXXXXXXXXXXXXXXXXXDD-3'
DsiRNAmm Antisense Strand: 3'-XEXXXXXXXXXXXXXXXXXXXXXXXX-5'

Target RNA Sequence:       5'-...AXXXXXXXXXXXXXXXXXXX...-3'
DsiRNAmm Sense Strand:     5'-BXXXXXXXXXXXXXXXXXXXXXXXDD-3'
DsiRNAmm Antisense Strand: 3'-XXEXXXXXXXXXXXXXXXXXXXXXXXX-5'

Target RNA Sequence:       5'-...XAXXXXXXXXXXXXXXXXXX...-3'
DsiRNAmm Sense Strand:     5'-XBXXXXXXXXXXXXXXXXXXXXXXDD-3'
DsiRNAmm Antisense Strand: 3'-XXXEXXXXXXXXXXXXXXXXXXXXXXX-5'

Target RNA Sequence:       5'-...XXAXXXXXXXXXXXXXXXXX...-3'
DsiRNAmm Sense Strand:     5'-XXBXXXXXXXXXXXXXXXXXXXXXDD-3'
DsiRNAmm Antisense Strand: 3'-XXXXEXXXXXXXXXXXXXXXXXXXXXX-5'

Target RNA Sequence:       5'-...XXXAXXXXXXXXXXXXXXXX...-3'
DsiRNAmm Sense Strand:     5'-XXXBXXXXXXXXXXXXXXXXXXXDD-3'
DsiRNAmm Antisense Strand: 3'-XXXXXEXXXXXXXXXXXXXXXXXXXXX-5'

Target RNA Sequence:       5'-...XXXXAXXXXXXXXXXXXXXX...-3'
DsiRNAmm Sense Strand:     5'-XXXXBXXXXXXXXXXXXXXXXXXDD-3'
DsiRNAmm Antisense Strand: 3'-XXXXXXEXXXXXXXXXXXXXXXXXXXX-5'

Target RNA Sequence:       5'-...XXXXXAXXXXXXXXXXXXXX...-3'
DsiRNAmm Sense Strand:     5'-XXXXXBXXXXXXXXXXXXXXXXXDD-3'
DsiRNAmm Antisense Strand: 3'-XXXXXXXEXXXXXXXXXXXXXXXXXXX-5'

Target RNA Sequence:       5'-...XXXXXXAXXXXXXXXXXXXX...-3'
DsiRNAmm Sense Strand:     5'-XXXXXXBXXXXXXXXXXXXXXXXDD-3'
DsiRNAmm Antisense Strand: 3'-XXXXXXXXEXXXXXXXXXXXXXXXXXX-5'

Target RNA Sequence:       5'-...XXXXXXXAXXXXXXXXXXXX...-3'
DsiRNAmm Sense Strand:     5'-XXXXXXXBXXXXXXXXXXXXXXXDD-3'
DsiRNAmm Antisense Strand: 3'-XXXXXXXXXEXXXXXXXXXXXXXXXXX-5'

Target RNA Sequence:       5'-...XXXXXXXXAXXXXXXXXXXX...-3'
DsiRNAmm Sense Strand:     5'-XXXXXXXXBXXXXXXXXXXXXXXDD-3'
DsiRNAmm Antisense Strand: 3'-XXXXXXXXXXEXXXXXXXXXXXXXXXX-5'

Target RNA Sequence:       5'-...XXXXXXXXXAXXXXXXXXXX...-3'
DsiRNAmm Sense Strand:     5'-XXXXXXXXXBXXXXXXXXXXXXXDD-3'
DsiRNAmm Antisense Strand: 3'-XXXXXXXXXXXEXXXXXXXXXXXXXXX-5'
``` wherein "X"=RNA, "D"=DNA and "E"=Nucleic acid residues (RNA, DNA or non-natural or modified nucleic acids) that do not base pair (hydrogen bond) with corresponding "A" RNA residues of otherwise complementary (target) strand when strands are annealed, yet optionally do base pair with corresponding "B" residues ("B" residues are also RNA, DNA or non-natural or modified nucleic acids). Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNA agents.

In certain embodiments, the guide strand of a dsRNA of the invention that is sufficiently complementary to a target RNA (e.g., mRNA) along at least 19 nucleotides of the target gene sequence to reduce target gene expression is not perfectly complementary to the at least 19 nucleotide long target gene sequence. Rather, it is appreciated that the guide strand of a dsRNA of the invention that is sufficiently complementary to a target mRNA along at least 19 nucleotides of a target RNA sequence to reduce target gene expression can have one, two, three, or even four or more nucleotides that are mismatched with the 19 nucleotide or longer target strand sequence. Thus, for a 19 nucleotide target RNA sequence, the guide strand of a dsRNA of the invention can be sufficiently complementary to the target RNA sequence to reduce target gene levels while possessing, e.g., only 15/19, 16/19, 17/19 or 18/19 matched nucleotide residues between guide strand and target RNA sequence.

In addition to the above-exemplified structures, dsRNAs of the invention can also possess one, two or three additional residues that form further mismatches with the target MET RNA sequence. Such mismatches can be consecutive, or can be interspersed by nucleotides that form matched base pairs with the target MET RNA sequence. Where interspersed by nucleotides that form matched base pairs, mismatched residues can be spaced apart from each other within a single strand at an interval of one, two, three, four, five, six, seven or even eight base paired nucleotides between such mismatch-forming residues.

As for the above-described DsiRNAmm agents, a preferred location within dsRNAs (e.g., DsiRNAs) for antisense strand nucleotides that form mismatched base pairs with target MET RNA sequence (yet may or may not form mismatches with corresponding sense strand nucleotides) is within the antisense strand region that is located 3' (downstream) of the antisense strand sequence which is complementary to the projected Ago2 cut site of the DsiRNA (e.g., in FIG. 1, the region of the antisense strand which is 3' of the projected Ago2 cut site is preferred for mismatch-forming residues and happens to be located at positions 17-23 of the antisense strand for the 25/27mer agent shown in FIG. 1). Thus, in one embodiment, the position of a mismatch nucleotide (in relation to the target MET RNA sequence) of the antisense strand of a DsiRNAmm is the nucleotide residue of the antisense strand that is located immediately 3' (downstream) within the antisense strand sequence of the projected Ago2 cleavage site of the corresponding target MET RNA sequence. In other preferred embodiments, a mismatch nucleotide of the antisense strand of a DsiR-NAmm (in relation to the target MET RNA sequence) is positioned at the nucleotide residue of the antisense strand that is located two nucleotides 3' (downstream) of the corresponding projected Ago2 cleavage site, three nucleotides 3' (downstream) of the corresponding projected Ago2 cleavage site, four nucleotides 3' (downstream) of the corresponding projected Ago2 cleavage site, five nucleotides 3' (downstream) of the corresponding projected Ago2 cleavage site, six nucleotides 3' (downstream) of the projected Ago2 cleavage site, seven nucleotides 3' (downstream) of the projected Ago2 cleavage site, eight nucleotides 3' (downstream) of the projected Ago2 cleavage site, or nine nucleotides 3' (downstream) of the projected Ago2 cleavage site.

In dsRNA agents possessing two mismatch-forming nucleotides of the antisense strand (where mismatch-forming nucleotides are mismatch forming in relation to target MET RNA sequence), mismatches can occur consecutively (e.g., at consecutive positions along the antisense strand nucleotide sequence). Alternatively, nucleotides of the antisense strand that form mismatched base pairs with the target MET RNA sequence can be interspersed by nucleotides that base pair with the target MET RNA sequence (e.g., for a DsiRNA possessing mismatch-forming nucleotides at positions 17 and 20 (starting from the 5' terminus (position 1) of the antisense strand of the 25/27mer agent shown in FIG. 1), but not at positions 18 and 19, the mismatched residues of sense strand positions 17 and 20 are interspersed by two nucleotides that form matched base pairs with corresponding residues of the target MET RNA sequence). For example, two residues of the antisense strand (located within the mismatch-tolerant region of the antisense strand) that form mismatched base pairs with the corresponding target MET RNA sequence can occur with zero, one, two, three, four or five matched base pairs (with respect to target MET RNA sequence) located between these mismatch-forming base pairs.

For certain dsRNAs possessing three mismatch-forming base pairs (mismatch-forming with respect to target MET RNA sequence), mismatch-forming nucleotides can occur consecutively (e.g., in a triplet along the antisense strand nucleotide sequence). Alternatively, nucleotides of the antisense strand that form mismatched base pairs with the target MET RNA sequence can be interspersed by nucleotides that form matched base pairs with the target MET RNA sequence (e.g., for a DsiRNA possessing mismatched nucleotides at positions 17, 18 and 22, but not at positions 19, 20 and 21, the mismatch-forming residues of antisense strand positions 17 and 18 are adjacent to one another, while the mismatch-forming residues of antisense strand positions 18 and 22 are interspersed by three nucleotides that form matched base pairs with corresponding residues of the target MET RNA). For example, three residues of the antisense strand (located within the mismatch-tolerant region of the antisense strand) that form mismatched base pairs with the corresponding target MET RNA sequence can occur with zero, one, two, three or four matched base pairs located between any two of these mismatch-forming base pairs.

For certain dsRNAs possessing four mismatch-forming base pairs (mismatch-forming with respect to target MET RNA sequence), mismatch-forming nucleotides can occur consecutively (e.g., in a quadruplet along the sense strand nucleotide sequence). Alternatively, nucleotides of the antisense strand that form mismatched base pairs with the target MET RNA sequence can be interspersed by nucleotides that form matched base pairs with the target MET RNA sequence (e.g., for a DsiRNA possessing mismatch-forming nucleotides at positions 17, 19, 21 and 22, but not at positions 18 and 20, the mismatch-forming residues of antisense strand positions 21 and 22 are adjacent to one another, while the mismatch-forming residues of antisense strand positions 17 and 19 are interspersed by one nucleotide that forms a matched base pair with the corresponding residue of the target MET RNA sequence—similarly, the mismatch-forming residues of antisense strand positions 19 and 21 are also interspersed by one nucleotide that forms a matched base pair with the corresponding residue of the target MET RNA sequence). For example, four residues of the antisense strand (located within the mismatch-tolerant region of the antisense strand) that form mismatched base pairs with the corresponding target MET RNA sequence can occur with zero, one, two or three matched base pairs located between any two of these mismatch-forming base pairs.

The above DsiRNAmm and other dsRNA structures are described in order to exemplify certain structures of DsiRNAmm and dsRNA agents. Design of the above DsiRNAmm and dsRNA structures can be adapted to generate, e.g., DsiRNAmm forms of other DsiRNA structures shown infra. As exemplified above, dsRNAs can also be designed that possess single mismatches (or two, three or four mismatches) between the antisense strand of the dsRNA and a target sequence, yet optionally can retain perfect complementarity between sense and antisense strand sequences of a dsRNA.

It is further noted that the dsRNA agents exemplified infra can also possess insertion/deletion (in/del) structures within their double-stranded and/or target MET RNA-aligned structures. Accordingly, the dsRNAs of the invention can be designed to possess in/del variations in, e.g., antisense strand sequence as compared to target MET RNA sequence and/or antisense strand sequence as compared to sense strand sequence, with preferred location(s) for placement of such in/del nucleotides corresponding to those locations described above for positioning of mismatched and/or mismatch-forming base pairs.

It is also noted that the DsiRNAs of the instant invention can tolerate mismatches within the 3'-terminal region of the sense strand/5'-terminal region of the antisense strand, as this region is modeled to be processed by Dicer and liberated from the guide strand sequence that loads into RISC. Exemplary DsiRNA structures of the invention that harbor such mismatches include the following:

```
Target RNA Sequence:     5'-...XXXXXXXXXXXXXXXXXXXXHXXX...-3'
DsiRNA Sense Strand:     5'-XXXXXXXXXXXXXXXXXXXXIXDD-3'
DsiRNA Antisense Strand: 3'-XXXXXXXXXXXXXXXXXXXXXJXXX-5'

Target RNA Sequence:     5'-...XXXXXXXXXXXXXXXXXXXXHXX...-3'
DsiRNA Sense Strand:     5'-XXXXXXXXXXXXXXXXXXXXIDD-3'
DsiRNA Antisense Strand: 3'-XXXXXXXXXXXXXXXXXXXXXJXX-5'
```

```
Target RNA Sequence:        5'-...XXXXXXXXXXXXXXXXXXXXXXXXXHX...-3'
DsiRNA Sense Strand:        5'-XXXXXXXXXXXXXXXXXXXXXXXXID-3'
DsiRNA Antisense Strand:    3'-XXXXXXXXXXXXXXXXXXXXXXXXXXXJX-5'

Target RNA Sequence:        5'-...XXXXXXXXXXXXXXXXXXXXXXXXXH...-3'
DsiRNA Sense Strand:        5'-XXXXXXXXXXXXXXXXXXXXXXXXDI-3'
DsiRNA Antisense Strand:    3'-XXXXXXXXXXXXXXXXXXXXXXXXXXXJ-5'
``` wherein "X"=RNA, "D"=DNA and "I" and "J"=Nucleic acid residues (RNA, DNA or non-natural or modified nucleic acids) that do not base pair (hydrogen bond) with one another, yet optionally "J" is complementary to target RNA sequence nucleotide "H". Any of the residues of such agents can optionally be 2'-O-methyl RNA monomers—alternating positioning of 2'-O-methyl RNA monomers that commences from the 3'-terminal residue of the bottom (second) strand, as shown above—or any of the above-described methylation patterns—can also be used in the above DsiRNA agents. The above mismatches can also be combined within the DsiRNAs of the instant invention.

In the below structures, such mismatches are introduced within the asymmetric MET-5548 DsiRNA (newly-introduced mismatch residues are italicized): MET-5548 25/27mer DsiRNA, mismatch position=22 of sense strand (from 5'-terminus)

```
5'-CUCAGCAUGUUUGUAAAGCAG^AAta-3'      (SEQ ID NO: 3030)
3'-UUGAGUCGUACAAACAUUUCGUC_CUAU-5'    (SEQ ID NO: 684)
```

Optionally, the mismatched "A" residue of position 22 of the sense strand is alternatively "U" or "C".
MET-5548 25/27mer DsiRNA, mismatch position=23 of sense strand

```
5'-CUCAGCAUGUUUGUAAAGCAGG^Cta-3'      (SEQ ID NO: 3031)
3'-UUGAGUCGUACAAACAUUUCGUCC_UAU-5'    (SEQ ID NO: 684)
```

Optionally, the mismatched "C" residue of position 23 of the sense strand is alternatively "G" or "U".
MET-5548 25/27mer DsiRNA, mismatch position=24 of sense strand

```
5'-CUCAGCAUGUUUGUAAAGCAGGA^Ca-3'      (SEQ ID NO: 3032)
3'-UUGAGUCGUACAAACAUUUCGUCCU_AU-5'    (SEQ ID NO: 684)
```

Optionally, the mismatched "c" residue of position 24 of the sense strand is alternatively "g" or "a".
MET-5548 25/27mer DsiRNA, mismatch position=25 of sense strand

```
5'-CUCAGCAUGUUUGUAAAGCAGGAt^C-3'      (SEQ ID NO: 3033)
3'-UUGAGUCGUACAAACAUUUCGUCCUA_U-5'    (SEQ ID NO: 684)
```

Optionally, the mismatched "c" residue of position 25 of the sense strand is alternatively "t" or "g".

MET-5548 25/27mer DsiRNA, mismatch position=1 of antisense strand

```
5'-CUCAGCAUGUUUGUAAAGCAGGAt^a-3'      (SEQ ID NO: 324)
3'-UUGAGUCGUACAAACAUUUCGUCCUA_C-5'    (SEQ ID NO: 3034)
```

Optionally, the mismatched "C" residue of position 1 of the antisense strand is alternatively "G" or "A".
MET-5548 25/27mer DsiRNA, mismatch position=2 of antisense strand

```
5'-CUCAGCAUGUUUGUAAAGCAGG^ta-3'       (SEQ ID NO: 324)
3'-UUGAGUCGUACAAACAUUUCGUCCU_CU-5'    (SEQ ID NO: 3035)
```

Optionally, the mismatched "C" residue of position 2 of the antisense strand is alternatively "G" or "U".
MET-5548 25/27mer DsiRNA, mismatch position=3 of antisense strand

```
5'-CUCAGCAUGUUUGUAAAGCAGG^Ata-3'      (SEQ ID NO: 324)
3'-UUGAGUCGUACAAACAUUUCGUCC_CAU-5'    (SEQ ID NO: 3036)
```

Optionally, the mismatched "C" residue of position 3 of the antisense strand is alternatively "A" or "G".
MET-5548 25/27mer DsiRNA, mismatch position=4 of antisense strand

```
5'-CUCAGCAUGUUUGUAAAGCAG^GAta-3'      (SEQ ID NO: 324)
3'-UUGAGUCGUACAAACAUUUCGUC_AUAU-5'    (SEQ ID NO: 3037)
```

Optionally, the mismatched "A" residue of position 4 of the antisense strand is alternatively "U" or "G".

In additional exemplary structures, such mismatches are introduced within the asymmetric MET-1982 DsiRNA (newly-introduced mismatch residues are italicized): MET-1982 25/27mer DsiRNA, mismatch position=22 of sense strand (from 5'-terminus)

```
5'-CGGAGGAAUAAUAAAUUUGAU^Cuaa-3'      (SEQ ID NO: 3038)
3'-AAGCCUCCUUAUUAUUUAAACUA_AAUU-5'    (SEQ ID NO: 460)
```

Optionally, the mismatched "C" residue of position 22 of the sense strand is alternatively "A" or "G".
MET-1982 25/27mer DsiRNA, mismatch position=23 of sense strand

```
5'-CGGAGGAAUAAUAAAUUUGAUU^Caa-3'      (SEQ ID NO: 3039)
3'-AAGCCUCCUUAUUAUUUAAACUAA_AUU-5'    (SEQ ID NO: 460)
```

Optionally, the mismatched "C" residue of position 23 of the sense strand is alternatively "G" or "A".

MET-1982 25/27mer DsiRNA, mismatch position=24 of sense strand

```
5'-CGGAGGAAUAAUAAAUUUGAUUU^Ca-3'  (SEQ ID NO: 3040)
3'-AAGCCUCCUUAUUAUUUAAACUAAA_UU-5' (SEQ ID NO: 460)
```

Optionally, the mismatched "c" residue of position 24 of the sense strand is alternatively "g" or "t".

MET-1982 25/27mer DsiRNA, mismatch position=25 of sense strand

```
5'-CGGAGGAAUAAUAAAUUUGAUUUa^C-3'  (SEQ ID NO: 3041)
3'-AAGCCUCCUUAUUAUUUAAACUAAAU_U-5' (SEQ ID NO: 460)
```

Optionally, the mismatched "c" residue of position 25 of the sense strand is alternatively "t" or "g".

MET-1982 25/27mer DsiRNA, mismatch position=1 of antisense strand

```
5'-CGGAGGAAUAAUAAAUUUGAUUUa^a-3' (SEQ ID NO: 100)
3'-AAGCCUCCUUAUUAUUUAAACUAAAU_C-5' (SEQ ID NO: 3042)
```

Optionally, the mismatched "C" residue of position 1 of the antisense strand is alternatively "G" or "A".

MET-1982 25/27mer DsiRNA, mismatch position=2 of antisense strand

```
5'-CGGAGGAAUAAUAAAUUUGAUUU^aa-3' (SEQ ID NO: 100)
3'-AAGCCUCCUUAUUAUUUAAACUAAA_CU-5' (SEQ ID NO: 3043)
```

Optionally, the mismatched "C" residue of position 2 of the antisense strand is alternatively "G" or "A".

MET-1982 25/27mer DsiRNA, mismatch position=3 of antisense strand

```
5'-CGGAGGAAUAAUAAAUUUGAU^Uaa-3' (SEQ ID NO: 100)
3'-AAGCCUCCUUAUUAUUUAAACUAA_CUU-5' (SEQ ID NO: 3044)
```

Optionally, the mismatched "C" residue of position 3 of the antisense strand is alternatively "U" or "G".

MET-1982 25/27mer DsiRNA, mismatch position=4 of antisense strand

```
5'-CGGAGGAAUAAUAAAUUUGAU^Uaa-3' (SEQ ID NO: 100)
3'-AAGCCUCCUUAUUAUUUAAACUA_CAUU-5' (SEQ ID NO: 3045)
```

Optionally, the mismatched "C" residue of position 4 of the antisense strand is alternatively "U" or "G".

In further exemplary structures, such mismatches are introduced within the asymmetric MET-3780 DsiRNA (newly-introduced mismatch residues are italicized):

MET-3780 25/27mer DsiRNA, mismatch position=22 of sense strand (from 5'-terminus)

```
5'-AGACUCAUAAUCCAACUGUAAAAga-3' (SEQ ID NO: 256)
3'-ACUCUGAGUAUUAGGUUGACAUUUUCU-5' (SEQ ID NO: 616)
MET-3780 Target: 5'-TGAGACTCATAATCCAACTGTAAAGA-3' (SEQ ID NO: 976)

5'-AGACUCAUAAUCCAACUGUAA^Caga-3' (SEQ ID NO: 3046)
3'-ACUCUGAGUAUUAGGUUGACAUU_UUCU-5' (SEQ ID NO: 616)
```

Optionally, the mismatched "C" residue of position 22 of the sense strand is alternatively "U" or "G".

MET-3780 25/27mer DsiRNA, mismatch position=23 of sense strand

```
5'-AGACUCAUAAUCCAACUGUAAA^Cga-3' (SEQ ID NO: 3047)
3'-ACUCUGAGUAUUAGGUUGACAUUU_CU-5' (SEQ ID NO: 616)
```

Optionally, the mismatched "C" residue of position 23 of the sense strand is alternatively "G" or "U".

MET-3780 25/27mer DsiRNA, mismatch position=24 of sense strand

```
5'-AGACUCAUAAUCCAACUGUAAAA^aa-3' (SEQ ID NO: 3048)
3'-ACUCUGAGUAUUAGGUUGACAUUUU_CU-5' (SEQ ID NO: 616)
```

Optionally, the mismatched "a" residue of position 24 of the sense strand is alternatively "t" or "c".

MET-3780 25/27mer DsiRNA, mismatch position=25 of sense strand

```
5'-AGACUCAUAAUCCAACUGUAAAAg^C-3' (SEQ ID NO: 3049)
3'-ACUCUGAGUAUUAGGUUGACAUUUUC_U-5' (SEQ ID NO: 616)
```

Optionally, the mismatched "c" residue of position 25 of the sense strand is alternatively "t" or "g".

MET-3780 25/27mer DsiRNA, mismatch position=1 of antisense strand

```
5'-AGACUCAUAAUCCAACUGUAAAAg^a-3' (SEQ ID NO: 256)
3'-ACUCUGAGUAUUAGGUUGACAUUUUC_C-5' (SEQ ID NO: 3050)
```

Optionally, the mismatched "C" residue of position 1 of the antisense strand is alternatively "G" or "A".

MET-3780 25/27mer DsiRNA, mismatch position=2 of antisense strand

```
5'-AGACUCAUAAUCCAACUGUAAAA^ga-3' (SEQ ID NO: 256)
3'-ACUCUGAGUAUUAGGUUGACAUUUU_AU-5' (SEQ ID NO: 3051)
```

Optionally, the mismatched "A" residue of position 2 of the antisense strand is alternatively "G" or "U".
MET-3780 25/27mer DsiRNA, mismatch position=3 of antisense strand

```
5'-AGACUCAUAAUCCAACUGUAAAAga-3'    (SEQ ID NO: 256)
3'-ACUCUGAGUAUUAGGUUGACAUUCCU-5'   (SEQ ID NO: 3052)
```

Optionally, the mismatched "C" residue of position 3 of the antisense strand is alternatively "A" or "G".
MET-3780 25/27mer DsiRNA, mismatch position=4 of antisense strand

```
5'-AGACUCAUAAUCCAACUGUAAAAga-3'    (SEQ ID NO: 256)
3'-ACUCUGAGUAUUAGGUUGACAUUCUCU-5'  (SEQ ID NO: 3053)
```

Optionally, the mismatched "C" residue of position 4 of the antisense strand is alternatively "A" or "G".

As noted above, introduction of such mismatches can be performed upon any of the DsiRNAs described herein.

The mismatches of such DsiRNA structures can be combined to produce a DsiRNA possessing, e.g., two, three or even four mismatches within the 3'-terminal four nucleotides of the sense strand/5'-terminal four nucleotides of the antisense strand.

Indeed, in view of the flexibility of sequences which can be incorporated into DsiRNAs at the 3'-terminal residues of the sense strand/5'-terminal residues of the antisense strand, in certain embodiments, the sequence requirements of an asymmetric DsiRNA of the instant invention can be represented as the following (minimalist) structure (shown for an exemplary MET-5548 DsiRNA sequence):

```
                                             (SEQ ID NO: 3054)
5'-CUCAGCAUGUUUGUAAAGCAGXXX[X]n-3'

(SEQ ID NO: 3055)
3'-UUGAGUCGUACAAACAUUUCGXXXXX[X]n-5'
``` where n=1 to 5, 1 to 10, 1 to 20, 1 to 30, 1 to 50, or 1 to 80 or more.
MET-5548 Target:

```
                                             (SEQ ID NO: 3056)
5'-AACTCAGCATGTTTGTAAAGCXXXXXX-3'
```

The MET target sight may also be a site which is targeted by one or more of several oligonucleotides whose complementary target sites overlap with a stated target site. For example, for an exemplary MET-3827 DsiRNA, it is noted that certain DsiRNAs targeting overlapping and only slightly offset MET sequences can exhibit activity levels similar to that of MET-3827 (specifically, see MET-3821 to MET-3834 of Table 11 below and MET-3822, MET-3826, MET-3827 and MET-3834 of FIG. 3-2. Thus, in certain embodiments, a designated target sequence region can be effectively targeted by a series of DsiRNAs possessing largely overlapping sequences. (E.g., if considering DsiRNAs surrounding the MET-3827 site, a more encompassing MET target sequence might be recited as, e.g., 5'-GTCT-TCAAGTAGCCAAAGGCATGAAATATCTTG-CAAGCAA-3' (SEQ ID NO: 3029), wherein any given DsiRNA (e.g., a DsiRNA selected from MET-3821 to MET-3834) only targets a sub-sequence within such a sequence region, yet the entire sequence can be considered a viable target for such a series of DsiRNAs).

Additionally and/or alternatively, mismatches within the 3'-terminal four nucleotides of the sense strand/5'-terminal four nucleotides of the antisense strand can be combined with mismatches positioned at other mismatch-tolerant positions, as described above.

In view of the present identification of the above-described Dicer substrate agents (DsiRNAs) as inhibitors of MET levels via targeting of specific MET sequences, it is also recognized that dsRNAs having structures similar to those described herein can also be synthesized which target other sequences within the MET sequence of NM_001127500.1, NM_000245.2 or NM_008591.2, or within variants thereof (e.g., target sequences possessing 80% identity, 90% identity, 95% identity, 96% identity, 97% identity, 98% identity, 99% or more identity to a sequence of NM_001127500.1, NM_000245.2 and/or NM_008591.2).

Anti-MET DsiRNA Design/Synthesis

It has been found empirically that longer dsRNA species of from 25 to 35 nucleotides (DsiRNAs) and especially from 25 to 30 nucleotides give unexpectedly effective results in terms of potency and duration of action, as compared to 19-23mer siRNA agents. Without wishing to be bound by the underlying theory of the dsRNA processing mechanism, it is thought that the longer dsRNA species serve as a substrate for the Dicer enzyme in the cytoplasm of a cell. In addition to cleaving the dsRNA of the invention into shorter segments, Dicer is thought to facilitate the incorporation of a single-stranded cleavage product derived from the cleaved dsRNA into the RISC complex that is responsible for the destruction of the cytoplasmic RNA (e.g., MET RNA) of or derived from the target gene, MET (or other gene associated with a MET-associated disease or disorder). Prior studies (Rossi et al., U.S. Patent Application No. 2007/0265220) have shown that the cleavability of a dsRNA species (specifically, a DsiRNA agent) by Dicer corresponds with increased potency and duration of action of the dsRNA species.

Certain preferred anti-MET DsiRNA agents were selected from a pre-screened population. Design of DsiRNAs can optionally involve use of predictive scoring algorithms that perform in silico assessments of the projected activity/efficacy of a number of possible DsiRNA agents spanning a region of sequence. Information regarding the design of such scoring algorithms can be found, e.g., in Gong et al. (*BMC Bioinformatics* 2006, 7:516), though a more recent "v3" algorithm represents a theoretically improved algorithm relative to siRNA scoring algorithms previously available in the art. (E.g., the "v3" and "v4" scoring algorithms are machine learning algorithms that are not reliant upon any biases in human sequence. In addition, the "v3" and "v4" algorithms derive from data sets that are many-fold larger than that from which an older "v2" algorithm such as that described in Gong et al. derives.)

The first and second oligonucleotides of the DsiRNA agents of the instant invention are not required to be completely complementary. In fact, in one embodiment, the 3'-terminus of the sense strand contains one or more mismatches. In one aspect, two mismatches are incorporated at the 3' terminus of the sense strand. In another embodiment, the DsiRNA of the invention is a double stranded RNA molecule containing two RNA oligonucleotides each of which is 27 nucleotides in length and, when annealed to each other, have blunt ends and a two nucleotide mismatch on the 3'-terminus of the sense strand (the 5'-terminus of the antisense strand). The use of mismatches or decreased thermodynamic stability (specifically at the 3'-sense/5'-antisense position) has been proposed to facilitate or favor entry of the antisense strand into RISC (Schwarz et al., 2003, *Cell* 115: 199-208; Khvorova et al., 2003, *Cell* 115: 209-216), presumably by affecting some rate-limiting unwinding steps that occur with entry of the siRNA into RISC. Thus, terminal base composition has been included in design algorithms for selecting active 21mer siRNA duplexes (Ui-Tei et al., 2004, *Nucleic Acids Res* 32: 936-948; Reynolds et al., 2004, *Nat Biotechnol* 22: 326-330). With Dicer cleavage of the dsRNA of this embodiment, the small end-terminal sequence which contains the mismatches will either be left unpaired with the antisense strand (become part of a 3'-overhang) or be cleaved entirely off the final 21-mer siRNA. These "mismatches", therefore, do not persist as mismatches in the final RNA component of RISC. The finding that base mismatches or destabilization of segments at the 3'-end of the sense strand of Dicer substrate improved the potency of synthetic duplexes in RNAi, presumably by facilitating processing by Dicer, was a surprising finding of past works describing the design and use of 25-30mer dsRNAs (also termed "DsiRNAs" herein; Rossi et al., U.S. Patent Application Nos. 2005/0277610, 2005/0244858 and 2007/0265220).

Modification of Anti-MET dsRNAs

One major factor that inhibits the effect of double stranded RNAs ("dsRNAs") is the degradation of dsRNAs (e.g., siRNAs and DsiRNAs) by nucleases. A 3'-exonuclease is the primary nuclease activity present in serum and modification of the 3'-ends of antisense DNA oligonucleotides is crucial to prevent degradation (Eder et al., 1991, *Antisense Res Dev*, 1: 141-151). An RNase-T family nuclease has been identified called ERI-1 which has 3' to 5' exonuclease activity that is involved in regulation and degradation of siRNAs (Kennedy et al., 2004, *Nature* 427: 645-649; Hong et al., 2005, *Biochem J*, 390: 675-679). This gene is also known as Thex1 (NM_02067) in mice or THEX1 (NM_153332) in humans and is involved in degradation of histone mRNA; it also mediates degradation of 3'-overhangs in siRNAs, but does not degrade duplex RNA (Yang et al., 2006, *J Biol Chem*, 281: 30447-30454). It is therefore reasonable to expect that 3'-end-stabilization of dsRNAs, including the DsiRNAs of the instant invention, will improve stability.

XRN1 (NM_019001) is a 5' to 3' exonuclease that resides in P-bodies and has been implicated in degradation of mRNA targeted by miRNA (Rehwinkel et al., 2005, *RNA* 11: 1640-1647) and may also be responsible for completing degradation initiated by internal cleavage as directed by a siRNA. XRN2 (NM_012255) is a distinct 5' to 3' exonuclease that is involved in nuclear RNA processing.

RNase A is a major endonuclease activity in mammals that degrades RNAs. It is specific for ssRNA and cleaves at the 3'-end of pyrimidine bases. SiRNA degradation products consistent with RNase A cleavage can be detected by mass spectrometry after incubation in serum (Turner et al., 2007, *Mol Biosyst* 3: 43-50). The 3'-overhangs enhance the susceptibility of siRNAs to RNase degradation. Depletion of RNase A from serum reduces degradation of siRNAs; this degradation does show some sequence preference and is worse for sequences having poly A/U sequence on the ends (Haupenthal et al., 2006 *Biochem Pharmacol* 71: 702-710). This suggests the possibility that lower stability regions of the duplex may "breathe" and offer transient single-stranded species available for degradation by RNase A. RNase A inhibitors can be added to serum and improve siRNA longevity and potency (Haupenthal et al., 2007, *Int J. Cancer* 121: 206-210).

In 21mers, phosphorothioate or boranophosphate modifications directly stabilize the internucleoside phosphate linkage. Boranophosphate modified RNAs are highly nuclease resistant, potent as silencing agents, and are relatively non-toxic. Boranophosphate modified RNAs cannot be manufactured using standard chemical synthesis methods and instead are made by in vitro transcription (IVT) (Hall et al., 2004, *Nucleic Acids Res* 32: 5991-6000; Hall et al., 2006, *Nucleic Acids Res* 34: 2773-2781). Phosphorothioate (PS) modifications can be easily placed in the RNA duplex at any desired position and can be made using standard chemical synthesis methods. The PS modification shows dose-dependent toxicity, so most investigators have recommended limited incorporation in siRNAs, favoring the 3'-ends where protection from nucleases is most important (Harborth et al., 2003, *Antisense Nucleic Acid Drug Dev* 13: 83-105; Chiu and Rana, 2003, Mol Cell 10: 549-561; Braasch et al., 2003, *Biochemistry* 42: 7967-7975; Amarzguioui et al., 2003, *Nucleic Acids Research* 31: 589-595). More extensive PS modification can be compatible with potent RNAi activity; however, use of sugar modifications (such as 2'-O-methyl RNA) may be superior (Choung et al., 2006, *Biochem Biophys Res Commun* 342: 919-927).

A variety of substitutions can be placed at the 2'-position of the ribose which generally increases duplex stability ($T_m$) and can greatly improve nuclease resistance. 2'-O-methyl RNA is a naturally occurring modification found in mammalian ribosomal RNAs and transfer RNAs. 2'-O-methyl modification in siRNAs is known, but the precise position of modified bases within the duplex is important to retain potency and complete substitution of 2'-O-methyl RNA for RNA will inactivate the siRNA. For example, a pattern that employs alternating 2'-O-methyl bases can have potency equivalent to unmodified RNA and is quite stable in serum (Choung et al., 2006, *Biochem Biophys Res Commun* 342: 919-927; Czauderna et al., 2003, *Nucleic Acids Research* 31: 2705-2716).

The 2'-fluoro (2'-F) modification is also compatible with dsRNA (e.g., siRNA and DsiRNA) function; it is most commonly placed at pyrimidine sites (due to reagent cost and availability) and can be combined with 2'-O-methyl modification at purine positions; 2'-F purines are available and can also be used. Heavily modified duplexes of this kind can be potent triggers of RNAi in vitro (Allerson et al., 2005, *J Med Chem* 48: 901-904; Prakash et al., 2005, *J Med Chem* 48: 4247-4253; Kraynack and Baker, 2006, RNA 12: 163-176) and can improve performance and extend duration of action when used in vivo (Morrissey et al., 2005, *Hepatology* 41: 1349-1356; Morrissey et al., 2005, *Nat Biotechnol* 23: 1002-1007). A highly potent, nuclease stable, blunt 19mer duplex containing alternative 2'-F and 2'-O-Me bases is taught by Allerson. In this design, alternating 2'-O-Me residues are positioned in an identical pattern to that employed by Czauderna, however the remaining RNA residues are converted to 2'-F modified bases. A highly potent, nuclease resistant siRNA employed by Morrissey employed a highly potent, nuclease resistant siRNA in vivo. In addition to 2'-O-Me RNA and 2'-F RNA, this duplex includes DNA, RNA, inverted abasic residues, and a 3'-terminal PS internucleoside linkage. While extensive modification has certain benefits, more limited modification of the duplex can also improve in vivo performance and is both simpler and less costly to manufacture. Soutschek et al. (2004, Nature 432: 173-178) employed a duplex in vivo and was mostly RNA with two 2'-O-Me RNA bases and limited 3'-terminal PS internucleoside linkages.

Locked nucleic acids (LNAs) are a different class of 2'-modification that can be used to stabilize dsRNA (e.g., siRNA and DsiRNA). Patterns of LNA incorporation that retain potency are more restricted than 2'-O-methyl or 2'-F bases, so limited modification is preferred (Braasch et al., 2003, Biochemistry 42: 7967-7975; Grunweller et al., 2003, Nucleic Acids Res 31: 3185-3193; Elmen et al., 2005, Nucleic Acids Res 33: 439-447). Even with limited incorporation, the use of LNA modifications can improve dsRNA performance in vivo and may also alter or improve off target effect profiles (Mook et al., 2007, Mol Cancer Ther 6: 833-843).

Synthetic nucleic acids introduced into cells or live animals can be recognized as "foreign" and trigger an immune response. Immune stimulation constitutes a major class of off-target effects which can dramatically change experimental results and even lead to cell death. The innate immune system includes a collection of receptor molecules that specifically interact with DNA and RNA that mediate these responses, some of which are located in the cytoplasm and some of which reside in endosomes (Marques and Williams, 2005, Nat Biotechnol 23: 1399-1405; Schlee et al., 2006, Mol Ther 14: 463-470). Delivery of siRNAs by cationic lipids or liposomes exposes the siRNA to both cytoplasmic and endosomal compartments, maximizing the risk for triggering a type 1 interferon (IFN) response both in vitro and in vivo (Morrissey et al., 2005, Nat Biotechnol 23: 1002-1007; Sioud and Sorensen, 2003, Biochem Biophys Res Commun 312: 1220-1225; Sioud, 2005, J Mol Biol 348: 1079-1090; Ma et al., 2005, Biochem Biophys Res Commun 330: 755-759). RNAs transcribed within the cell are less immunogenic (Robbins et al., 2006, Nat Biotechnol 24: 566-571) and synthetic RNAs that are immunogenic when delivered using lipid-based methods can evade immune stimulation when introduced unto cells by mechanical means, even in vivo (Heidel et al., 2004, Nat Biotechnol 22: 1579-1582). However, lipid based delivery methods are convenient, effective, and widely used. Some general strategy to prevent immune responses is needed, especially for in vivo application where all cell types are present and the risk of generating an immune response is highest. Use of chemically modified RNAs may solve most or even all of these problems.

In certain embodiments, modifications can be included in the anti-MET dsRNA agents of the present invention so long as the modification does not prevent the dsRNA agent from possessing MET inhibitory activity. In one embodiment, one or more modifications are made that enhance Dicer processing of the DsiRNA agent (an assay for determining Dicer processing of a DsiRNA is described elsewhere herein). In a second embodiment, one or more modifications are made that result in more effective MET inhibition (as described herein, MET inhibition/MET inhibitory activity of a dsRNA can be assayed via art-recognized methods for determining RNA levels, or for determining MET polypeptide levels, should such levels be assessed in lieu of or in addition to assessment of, e.g., MET mRNA levels). In a third embodiment, one or more modifications are made that support greater MET inhibitory activity (means of determining MET inhibitory activity are described supra). In a fourth embodiment, one or more modifications are made that result in greater potency of MET inhibitory activity per each dsRNA agent molecule to be delivered to the cell (potency of MET inhibitory activity is described supra). Modifications can be incorporated in the 3'-terminal region, the 5'-terminal region, in both the 3'-terminal and 5'-terminal region or in some instances in various positions within the sequence. With the restrictions noted above in mind, numbers and combinations of modifications can be incorporated into the dsRNA agent. Where multiple modifications are present, they may be the same or different. Modifications to bases, sugar moieties, the phosphate backbone, and their combinations are contemplated. Either 5'-terminus can be phosphorylated.

Examples of modifications contemplated for the phosphate backbone include phosphonates, including methylphosphonate, phosphorothioate, and phosphotriester modifications such as alkylphosphotriesters, and the like. Examples of modifications contemplated for the sugar moiety include 2'-alkyl pyrimidine, such as 2'-O-methyl, 2'-fluoro, amino, and deoxy modifications and the like (see, e.g., Amarzguioui et al., 2003, Nucleic Acids Research 31: 589-595). Examples of modifications contemplated for the base groups include abasic sugars, 2-O-alkyl modified pyrimidines, 4-thiouracil, 5-bromouracil, 5-iodouracil, and 5-(3-aminoallyl)-uracil and the like. Locked nucleic acids, or LNA's, could also be incorporated. Many other modifications are known and can be used so long as the above criteria are satisfied. Examples of modifications are also disclosed in U.S. Pat. Nos. 5,684,143, 5,858,988 and 6,291,438 and in U.S. published patent application No. 2004/0203145 A1. Other modifications are disclosed in Herdewijn (2000, Antisense Nucleic Acid Drug Dev 10: 297-310), Eckstein (2000, Antisense Nucleic Acid Drug Dev 10: 117-21), Rusckowski et al. (2000, Antisense Nucleic Acid Drug Dev 10: 333-345), Stein et al. (2001, Antisense Nucleic Acid Drug Dev 11: 317-25); Vorobjev et al. (2001, Antisense Nucleic Acid Drug Dev 11: 77-85).

One or more modifications contemplated can be incorporated into either strand. The placement of the modifications in the dsRNA agent can greatly affect the characteristics of the dsRNA agent, including conferring greater potency and stability, reducing toxicity, enhance Dicer processing, and minimizing an immune response. In one embodiment, the antisense strand or the sense strand or both strands have one or more 2'-O-methyl modified nucleotides. In another embodiment, the antisense strand contains 2'-O-methyl modified nucleotides. In another embodiment, the antisense stand contains a 3' overhang that is comprised of 2'-O-methyl modified nucleotides. The antisense strand could also include additional 2'-O-methyl modified nucleotides.

In certain embodiments, the anti-MET DsiRNA agent of the invention has several properties which enhance its processing by Dicer. According to such embodiments, the DsiRNA agent has a length sufficient such that it is processed by Dicer to produce an siRNA and at least one of the following properties: (i) the DsiRNA agent is asymmetric, e.g., has a 3' overhang on the sense strand and (ii) the DsiRNA agent has a modified 3' end on the antisense strand to direct orientation of Dicer binding and processing of the dsRNA to an active siRNA. According to these embodiments, the longest strand in the DsiRNA agent comprises 25-30 nucleotides. In one embodiment, the sense strand comprises 25-30 nucleotides and the antisense strand comprises 25-28 nucleotides. Thus, the resulting dsRNA has an overhang on the 3' end of the sense strand. The overhang is 1-4 nucleotides, such as 2 nucleotides. The antisense strand may also have a 5' phosphate.

In certain embodiments, the sense strand of a DsiRNA agent is modified for Dicer processing by suitable modifiers located at the 3' end of the sense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the sense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the sense strand in place of two ribonucleotides forming a blunt end of the duplex on the 5' end of the antisense strand and the 3' end of the sense strand, and a two-nucleotide RNA overhang is located on the 3'-end of the antisense strand. This is an asymmetric composition with DNA on the blunt end and RNA bases on the overhanging end.

In certain other embodiments, the antisense strand of a DsiRNA agent is modified for Dicer processing by suitable modifiers located at the 3' end of the antisense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the antisense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the antisense strand in place of two ribonucleotides forming a blunt end of the duplex on the 5' end of the sense strand and the 3' end of the antisense strand, and a two-nucleotide RNA overhang is located on the 3'-end of the sense strand. This is also an asymmetric composition with DNA on the blunt end and RNA bases on the overhanging end.

The sense and antisense strands anneal under biological conditions, such as the conditions found in the cytoplasm of a cell. In addition, a region of one of the sequences, particularly of the antisense strand, of the dsRNA has a sequence length of at least 19 nucleotides, wherein these nucleotides are adjacent to the 3' end of antisense strand and are sufficiently complementary to a nucleotide sequence of the target MET RNA.

Additionally, the DsiRNA agent structure can be optimized to ensure that the oligonucleotide segment generated from Dicer's cleavage will be the portion of the oligonucleotide that is most effective in inhibiting gene expression. For example, in one embodiment of the invention, a 27-bp oligonucleotide of the DsiRNA agent structure is synthesized wherein the anticipated 21 to 22-bp segment that will inhibit gene expression is located on the 3'-end of the antisense strand. The remaining bases located on the 5'-end of the antisense strand will be cleaved by Dicer and will be discarded. This cleaved portion can be homologous (i.e., based on the sequence of the target sequence) or non-homologous and added to extend the nucleic acid strand.

US 2007/0265220 discloses that 27mer DsiRNAs show improved stability in serum over comparable 21mer siRNA compositions, even absent chemical modification. Modifications of DsiRNA agents, such as inclusion of 2'-O-methyl RNA in the antisense strand, in patterns such as detailed above, when coupled with addition of a 5' Phosphate, can improve stability of DsiRNA agents. Addition of 5'-phosphate to all strands in synthetic RNA duplexes may be an inexpensive and physiological method to confer some limited degree of nuclease stability.

The chemical modification patterns of the dsRNA agents of the instant invention are designed to enhance the efficacy of such agents. Accordingly, such modifications are designed to avoid reducing potency of dsRNA agents; to avoid interfering with Dicer processing of DsiRNA agents; to improve stability in biological fluids (reduce nuclease sensitivity) of dsRNA agents; or to block or evade detection by the innate immune system. Such modifications are also designed to avoid being toxic and to avoid increasing the cost or impact the ease of manufacturing the instant dsRNA agents of the invention.

In certain embodiments of the present invention, an anti-MET DsiRNA agent has one or more of the following properties: (i) the DsiRNA agent is asymmetric, e.g., has a 3' overhang on the antisense strand and (ii) the DsiRNA agent has a modified 3' end on the sense strand to direct orientation of Dicer binding and processing of the dsRNA to an active siRNA. According to this embodiment, the longest strand in the dsRNA comprises 25-35 nucleotides (e.g., 25, 26, 27, 28, 29, 30, 31, 32, 33, 34 or 35 nucleotides). In certain such embodiments, the DsiRNA agent is asymmetric such that the sense strand comprises 25-34 nucleotides and the 3' end of the sense strand forms a blunt end with the 5' end of the antisense strand while the antisense strand comprises 26-35 nucleotides and forms an overhang on the 3' end of the antisense strand. In one embodiment, the DsiRNA agent is asymmetric such that the sense strand comprises 25-28 nucleotides and the antisense strand comprises 25-30 nucleotides. Thus, the resulting dsRNA has an overhang on the 3' end of the antisense strand. The overhang is 1-4 nucleotides, for example 2 nucleotides. The sense strand may also have a 5' phosphate.

The DsiRNA agent can also have one or more of the following additional properties: (a) the antisense strand has a right shift from the typical 21mer (e.g., the DsiRNA comprises a length of antisense strand nucleotides that extends to the 5' of a projected Dicer cleavage site within the DsiRNA, with such antisense strand nucleotides base paired with corresponding nucleotides of the sense strand extending 3' of a projected Dicer cleavage site in the sense strand), (b) the strands may not be completely complementary, i.e., the strands may contain simple mismatched base pairs (in certain embodiments, the DsiRNAs of the invention possess 1, 2, 3, 4 or even 5 or more mismatched base pairs, provided that MET inhibitory activity of the DsiRNA possessing mismatched base pairs is retained at sufficient levels (e.g., retains at least 50% MET inhibitory activity or more, at least 60% MET inhibitory activity or more, at least 70% MET inhibitory activity or more, at least 80% MET inhibitory activity or more, at least 90% MET inhibitory activity or more or at least 95% MET inhibitory activity or more as compared to a corresponding DsiRNA not possessing mismatched base pairs. In certain embodiments, mismatched base pairs exist between the antisense and sense strands of a DsiRNA. In some embodiments, mismatched base pairs exist (or are predicted to exist) between the antisense strand and the target RNA. In certain embodiments, the presence of a mismatched base pair(s) between an antisense strand residue and a corresponding residue within the target RNA that is located 3' in the target RNA sequence of a projected Ago2 cleavage site retains and may even enhance MET inhibitory activity of a DsiRNA of the invention) and (c) base modifications such as locked nucleic acid(s) may be included in the 5' end of the sense strand. A "typical" 21mer siRNA is designed using conventional techniques. In one technique, a variety of sites are commonly tested in parallel or pools containing several distinct siRNA duplexes specific to the same target with the hope that one of the reagents will be effective (Ji et al., 2003, *FEBS Lett* 552: 247-252). Other techniques use design rules and algorithms to increase the likelihood of obtaining active RNAi effector molecules (Schwarz et al., 2003, *Cell* 115: 199-208; Khvorova et al., 2003, *Cell* 115: 209-216; Ui-Tei et al., 2004, *Nucleic Acids Res* 32: 936-948; Reynolds et al., 2004, *Nat Biotechnol* 22: 326-330; Krol et al., 2004, *J Biol Chem* 279: 42230-42239; Yuan et al., 2004, *Nucl Acids Res* 32(Webserver issue): W130-134; Boese et al., 2005, *Methods Enzymol* 392: 73-96). High throughput selection of siRNA has also been developed (U.S. published patent application No. 2005/0042641 A1). Potential target sites can also be analyzed by secondary structure predictions (Heale et al., 2005, *Nucleic Acids Res* 33(3): e30). This 21mer is then used to design a right shift to include 3-9 additional nucleotides on the 5' end of the 21mer. The sequence of these additional nucleotides is not restricted. In one embodiment, the added ribonucleotides are based on the sequence of the target gene. Even in this embodiment, full complementarity between the target sequence and the antisense siRNA is not required.

The first and second oligonucleotides of a DsiRNA agent of the instant invention are not required to be completely complementary. They only need to be sufficiently complementary to anneal under biological conditions and to provide a substrate for Dicer that produces a siRNA sufficiently complementary to the target sequence. Locked nucleic acids, or LNA's, are well known to a skilled artisan (Elmen et al., 2005, *Nucleic Acids Res* 33: 439-447; Kurreck et al., 2002, *Nucleic Acids Res* 30: 1911-1918; Crinelli et al., 2002, *Nucleic Acids Res* 30: 2435-2443; Braasch and Corey, 2001, *Chem Biol* 8: 1-7; Bondensgaard et al., 2000, *Chemistry* 6: 2687-2695; Wahlestedt et al., 2000, *Proc Natl Acad Sci USA* 97: 5633-5638). In one embodiment, an LNA is incorporated at the 5' terminus of the sense strand. In another embodiment, an LNA is incorporated at the 5' terminus of the sense strand in duplexes designed to include a 3' overhang on the antisense strand.

In certain embodiments, the DsiRNA agent of the instant invention has an asymmetric structure, with the sense strand having a 25-base pair length, and the antisense strand having a 27-base pair length with a 2 base 3'-overhang. In other embodiments, this DsiRNA agent having an asymmetric structure further contains 2 deoxynucleotides at the 3' end of the sense strand in place of two of the ribonucleotides.

Certain DsiRNA agent compositions containing two separate oligonucleotides can be linked by a third structure. The third structure will not block Dicer activity on the DsiRNA agent and will not interfere with the directed destruction of the RNA transcribed from the target gene. In one embodiment, the third structure may be a chemical linking group. Many suitable chemical linking groups are known in the art and can be used. Alternatively, the third structure may be an oligonucleotide that links the two oligonucleotides of the DsiRNA agent in a manner such that a hairpin structure is produced upon annealing of the two oligonucleotides making up the dsRNA composition. The hairpin structure will not block Dicer activity on the DsiRNA agent and will not interfere with the directed destruction of the MET RNA.

MET cDNA and Polypeptide Sequences

Known human and mouse MET cDNA and polypeptide sequences include the following: human wild-type MET proto-oncogene (hepatocyte growth factor receptor) (MET) cDNA sequences GenBank Accession Nos. NM_001127500.1 (transcript variant 1) and NM_000245.2 (transcript variant 2); corresponding human MET polypeptide sequences GenBank Accession Nos. NP_001120972.1 (transcript variant 1) and NP_000236.2 (transcript variant 2); mouse wild-type MET sequence GenBank Accession No. NM_008591.2 (*Mus musculus* C57BL/6 MET transcript) and corresponding mouse MET polypeptide sequence GenBank Accession No. NP_032617.2.

In Vitro Assay to Assess dsRNA MET Inhibitory Activity

An in vitro assay that recapitulates RNAi in a cell-free system can be used to evaluate dsRNA constructs targeting MET RNA sequence(s), and thus to assess MET-specific gene inhibitory activity (also referred to herein as MET inhibitory activity) of a dsRNA. The assay comprises the system described by Tuschl et al., 1999, Genes and Development, 13, 3191-3197 and Zamore et al., 2000, Cell, 101, 25-33 adapted for use with dsRNA (e.g., DsiRNA) agents directed against MET RNA. A *Drosophila* extract derived from syncytial blastoderm is used to reconstitute RNAi activity in vitro. Target RNA is generated via in vitro transcription from a selected MET expressing plasmid using T7 RNA polymerase or via chemical synthesis. Sense and antisense dsRNA strands (for example, 20 uM each) are annealed by incubation in buffer (such as 100 mM potassium acetate, 30 mM HEPES-KOH, pH 7.4, 2 mM magnesium acetate) for 1 minute at 90° C. followed by 1 hour at 37° C., then diluted in lysis buffer (for example 100 mM potassium acetate, 30 mM HEPES-KOH at pH 7.4, 2 mM magnesium acetate). Annealing can be monitored by gel electrophoresis on an agarose gel in TBE buffer and stained with ethidium bromide. The *Drosophila* lysate is prepared using zero to two-hour-old embryos from Oregon R flies collected on yeasted molasses agar that are dechorionated and lysed. The lysate is centrifuged and the supernatant isolated. The assay comprises a reaction mixture containing 50% lysate [vol/vol], RNA (10-50 pM final concentration), and 10% [vol/vol] lysis buffer containing dsRNA (10 nM final concentration). The reaction mixture also contains 10 mM creatine phosphate, 10 ug/ml creatine phosphokinase, 100 um GTP, 100 uM UTP, 100 uM CTP, 500 uM ATP, 5 mM DTT, 0.1 U/uL RNasin (Promega), and 100 uM of each amino acid. The final concentration of potassium acetate is adjusted to 100 mM. The reactions are pre-assembled on ice and pre-incubated at 25° C. for 10 minutes before adding RNA, then incubated at 25° C. for an additional 60 minutes. Reactions are quenched with 4 volumes of 1.25×Passive Lysis Buffer (Promega). Target RNA cleavage is assayed by RT-PCR analysis or other methods known in the art and are compared to control reactions in which dsRNA is omitted from the reaction.

Alternately, internally-labeled target RNA for the assay is prepared by in vitro transcription in the presence of [α-$^{32}$P] CTP, passed over a G50 Sephadex column by spin chromatography and used as target RNA without further purification. Optionally, target RNA is 5'-$^{32}$P-end labeled using T4 polynucleotide kinase enzyme. Assays are performed as described above and target RNA and the specific RNA cleavage products generated by RNAi are visualized on an autoradiograph of a gel. The percentage of cleavage is determined by PHOSPHOR IMAGER® (autoradiography) quantitation of bands representing intact control RNA or RNA from control reactions without dsRNA and the cleavage products generated by the assay.

In one embodiment, this assay is used to determine target sites in the MET RNA target for dsRNA mediated RNAi cleavage, wherein a plurality of dsRNA constructs are screened for RNAi mediated cleavage of the MET RNA target, for example, by analyzing the assay reaction by electrophoresis of labeled target RNA, or by northern blotting, as well as by other methodology well known in the art.

In certain embodiments, a dsRNA of the invention is deemed to possess MET inhibitory activity if, e.g., a 50% reduction in MET RNA levels is observed in a system, cell, tissue or organism, relative to a suitable control. Additional metes and bounds for determination of MET inhibitory activity of a dsRNA of the invention are described supra.

Conjugation and Delivery of Anti-MET dsRNA Agents

In certain embodiments the present invention relates to a method for treating a subject having a MET-associated disease or disorder, or at risk of developing a MET-associated disease or disorder. In such embodiments, the dsRNA can act as novel therapeutic agents for controlling the MET-associated disease or disorder. The method comprises administering a pharmaceutical composition of the invention to the patient (e.g., human), such that the expression, level and/or activity of a MET RNA is reduced. The expression, level and/or activity of a polypeptide encoded by a MET RNA might also be reduced by a dsRNA of the instant invention, even where said dsRNA is directed against a non-coding region of the MET transcript (e.g., a targeted 5' UTR or 3' UTR sequence). Because of their high specificity, the dsRNAs of the present invention can specifically target MET sequences of cells and tissues, optionally in an allele-specific manner where polymorphic alleles exist within an individual and/or population.

In the treatment of a MET-associated disease or disorder, the dsRNA can be brought into contact with the cells or tissue of a subject, e.g., the cells or tissue of a subject exhibiting disregulation of MET and/or otherwise targeted for reduction of MET levels. For example, dsRNA substantially identical to all or part of a MET RNA sequence, may be brought into contact with or introduced into such a cell, either in vivo or in vitro. Similarly, dsRNA substantially identical to all or part of a MET RNA sequence may administered directly to a subject having or at risk of developing a MET-associated disease or disorder.

Therapeutic use of the dsRNA agents of the instant invention can involve use of formulations of dsRNA agents comprising multiple different dsRNA agent sequences. For example, two or more, three or more, four or more, five or more, etc. of the presently described agents can be combined to produce a formulation that, e.g., targets multiple different regions of the MET RNA, or that not only target MET RNA but also target, e.g., cellular target genes associated with a MET-associated disease or disorder. A dsRNA agent of the instant invention may also be constructed such that either strand of the dsRNA agent independently targets two or more regions of MET RNA, or such that one of the strands of the dsRNA agent targets a cellular target gene of MET known in the art.

Use of multifunctional dsRNA molecules that target more then one region of a target nucleic acid molecule can also provide potent inhibition of MET RNA levels and expression. For example, a single multifunctional dsRNA construct of the invention can target both the MET-1385 and MET-4012 sites simultaneously; additionally and/or alternatively, single or multifunctional agents of the invention can be designed to selectively target one splice variant of MET over another.

Thus, the dsRNA agents of the instant invention, individually, or in combination or in conjunction with other drugs, can be used to treat, inhibit, reduce, or prevent a MET-associated disease or disorder. For example, the dsRNA molecules can be administered to a subject or can be administered to other appropriate cells evident to those skilled in the art, individually or in combination with one or more drugs under conditions suitable for the treatment.

The dsRNA molecules also can be used in combination with other known treatments to treat, inhibit, reduce, or prevent a MET-associated disease or disorder in a subject or organism. For example, the described molecules could be used in combination with one or more known compounds, treatments, or procedures to treat, inhibit, reduce, or prevent a MET-associated disease or disorder in a subject or organism as are known in the art.

A dsRNA agent of the invention can be conjugated (e.g., at its 5' or 3' terminus of its sense or antisense strand) or unconjugated to another moiety (e.g. a non-nucleic acid moiety such as a peptide), an organic compound (e.g., a dye, cholesterol, or the like). Modifying dsRNA agents in this way may improve cellular uptake or enhance cellular targeting activities of the resulting dsRNA agent derivative as compared to the corresponding unconjugated dsRNA agent, are useful for tracing the dsRNA agent derivative in the cell, or improve the stability of the dsRNA agent derivative compared to the corresponding unconjugated dsRNA agent.

Methods of Introducing Nucleic Acids, Vectors, and Host Cells dsRNA agents of the invention may be directly introduced into a cell (i.e., intracellularly); or introduced extracellularly into a cavity, interstitial space, into the circulation of an organism, introduced orally, or may be introduced by bathing a cell or organism in a solution containing the nucleic acid. Vascular or extravascular circulation, the blood or lymph system, and the cerebrospinal fluid are sites where the nucleic acid may be introduced.

The dsRNA agents of the invention can be introduced using nucleic acid delivery methods known in art including injection of a solution containing the nucleic acid, bombardment by particles covered by the nucleic acid, soaking the cell or organism in a solution of the nucleic acid, or electroporation of cell membranes in the presence of the nucleic acid. Other methods known in the art for introducing nucleic acids to cells may be used, such as lipid-mediated carrier transport, chemical-mediated transport, and cationic liposome transfection such as calcium phosphate, and the like. The nucleic acid may be introduced along with other components that perform one or more of the following activities: enhance nucleic acid uptake by the cell or otherwise increase inhibition of the target MET RNA.

A cell having a target MET RNA may be from the germ line or somatic, totipotent or pluripotent, dividing or non-dividing, parenchyma or epithelium, immortalized or transformed, or the like. The cell may be a stem cell or a differentiated cell. Cell types that are differentiated include adipocytes, fibroblasts, myocytes, cardiomyocytes, endothelium, neurons, glia, blood cells, megakaryocytes, lymphocytes, macrophages, neutrophils, eosinophils, basophils, mast cells, leukocytes, granulocytes, keratinocytes, chondrocytes, osteoblasts, osteoclasts, hepatocytes, and cells of the endocrine or exocrine glands.

Depending on the particular target MET RNA sequence and the dose of dsRNA agent material delivered, this process may provide partial or complete loss of function for the MET RNA. A reduction or loss of RNA levels or expression (either MET RNA expression or encoded polypeptide expression) in at least 50%, 60%, 70%, 80%, 90%, 95% or 99% or more of targeted cells is exemplary. Inhibition of MET RNA levels or expression refers to the absence (or observable decrease) in the level of MET RNA or MET RNA-encoded protein. Specificity refers to the ability to inhibit the MET RNA without manifest effects on other genes of the cell. The consequences of inhibition can be confirmed by examination of the outward properties of the cell or organism or by biochemical techniques such as RNA solution hybridization, nuclease protection, Northern hybridization, reverse transcription, gene expression monitoring with a microarray, antibody binding, enzyme linked immunosorbent assay (ELISA), Western blotting, radioimmunoassay (RIA), other immunoassays, and fluorescence activated cell analysis (FACS). Inhibition of target MET RNA sequence(s) by the dsRNA agents of the invention also can be measured based upon the effect of administration of such dsRNA agents upon development/progression of a MET-associated disease or disorder, e.g., tumor formation, growth, metastasis, etc., either in vivo or in vitro. Treatment and/or reductions in tumor or cancer cell levels can include halting or reduction of growth of tumor or cancer cell levels or reductions of, e.g., 10%, 20%, 30%, 40%, 50%, 60%, 70%, 80%, 90%, 95% or 99% or more, and can also be measured in logarithmic terms, e.g., 10-fold, 100-fold, 1000-fold, $10^5$-fold, $10^6$-fold, $10^7$-fold reduction in cancer cell levels could be achieved via administration of the dsRNA agents of the invention to cells, a tissue, or a subject.

For RNA-mediated inhibition in a cell line or whole organism, expression a reporter or drug resistance gene whose protein product is easily assayed can be measured. Such reporter genes include acetohydroxyacid synthase (AHAS), alkaline phosphatase (AP), beta galactosidase (LacZ), beta glucoronidase (GUS), chloramphenicol acetyltransferase (CAT), green fluorescent protein (GFP), horseradish peroxidase (HRP), luciferase (Luc), nopaline synthase (NOS), octopine synthase (OCS), and derivatives thereof. Multiple selectable markers are available that confer resistance to ampicillin, bleomycin, chloramphenicol, gentamycin, hygromycin, kanamycin, lincomycin, methotrexate, phosphinothricin, puromycin, and tetracyclin. Depending on the assay, quantitation of the amount of gene expression allows one to determine a degree of inhibition which is greater than 10%, 33%, 50%, 90%, 95% or 99% as compared to a cell not treated according to the present invention.

Lower doses of injected material and longer times after administration of RNA silencing agent may result in inhibition in a smaller fraction of cells (e.g., at least 10%, 20%, 50%, 75%, 90%, or 95% of targeted cells). Quantitation of gene expression in a cell may show similar amounts of inhibition at the level of accumulation of target MET RNA or translation of target protein. As an example, the efficiency of inhibition may be determined by assessing the amount of gene product in the cell; RNA may be detected with a hybridization probe having a nucleotide sequence outside the region used for the inhibitory dsRNA, or translated polypeptide may be detected with an antibody raised against the polypeptide sequence of that region.

The dsRNA agent may be introduced in an amount which allows delivery of at least one copy per cell. Higher doses (e.g., at least 5, 10, 100, 500 or 1000 copies per cell) of material may yield more effective inhibition; lower doses may also be useful for specific applications.

MET Biology and Known MET-Targeting Therapeutics

MET is a membrane receptor that is essential for embryonic development and wound healing. Hepatocyte growth factor (HGF) is the only known ligand of the MET receptor. MET is normally expressed by cells of epithelial origin, while expression of HGF is restricted to cells of mesenchymal origin. Upon HGF stimulation, MET induces several biological responses that collectively give rise to a program known as invasive growth.

Abnormal MET activation in cancer correlates with poor prognosis, where aberrantly active MET triggers tumor growth, formation of new blood vessels (angiogenesis) that supply the tumor with nutrients, and cancer spread to other organs (metastasis). MET is deregulated in many types of human malignancies, including cancers of kidney, liver, stomach, breast, and brain. Normally, only stem cells and progenitor cells express MET, which allows these cells to grow invasively in order to generate new tissues in an embryo or regenerate damaged tissues in an adult. However, cancer stem cells are thought to hijack the ability of normal stem cells to express MET, and thus become the cause of cancer persistence and spread to other sites in the body.

MET protein is a receptor tyrosine kinase (RTK) that is produced as a single-chain precursor. The precursor is proteolytically cleaved at a furin site to yield a highly glycosylated extracellular α-subunit and a transmembrane β-subunit, which are linked together by a disulfide bridge (Birchmeier et al. Nat. Rev. Mol. Cell. Biol. 4: 915-25).

The MET protein comprises the following extracellular structures: a region of homology to semaphorins (Sema domain), which includes the full α-chain and the N-terminal part of the β-chain; a cysteine-rich MET-related sequence (MRS domain); Glycine-proline-rich repeats (G-P repeats); and four immunoglobulin-like structures (Ig domains), a typical protein-protein interaction region (Birchmeier et al. Nat. Rev. Mol. Cell. Biol. 4: 915-25). Intracellularly, the MET Protein comprises: a juxtamembrane segment that comprising a serine residue (Ser 985) that inhibits the receptor kinase activity upon phosphorylation (Gandino et al. J. Biol. Chem. 269: 1815-20); a tyrosine (Tyr 1003) that is responsible for MET polyubiquitination, endocytosis, and degradation upon interaction with the ubiquitin ligase CBL (Peschard et al. Mol. Cell. 8: 995-1004); a tyrosine kinase domain, which mediates MET biological activity. Following MET activation, transphosphorylation occurs on Tyr 1234 and Tyr 1235; and a C-terminal region that contains two crucial tyrosines (Tyr 1349 and Tyr 1356) that are inserted into the multisubstrate docking site, capable of recruiting downstream adapter proteins with Src homology-2 (SH2) domains (Ponzetto et al. Cell 77: 261-71). The two tyrosines of the docking site have been reported to be necessary and sufficient for the signal transduction both in vitro and in vivo (Ponzetto et al., ibid; Maim et al. *Cell* 87: 531-42).

MET activation by its ligand, HGF, induces MET kinase catalytic activity, which triggers transphosphorylation of the tyrosines Tyr 1234 and Tyr 1235. These two tyrosines engage various signal transducers, thus initiating a whole spectrum of biological activities driven by MET, collectively knows as the invasive growth program. The transducers interact with the intracellular multisubstrate docking site of MET either directly, such as GRB2, SHC (Pelicci et al. *Oncogene* 10: 1631-8), SRC, and the p85 regulatory subunit of phosphatidylinositol-3 kinase (PI3K; Pellicci et al., ibid), or indirectly through the scaffolding protein Gab1 (Weidner et al. *Nature* 384:173-6). Tyr 1349 and Tyr 1356 of the multisubstrate docking site are both involved in the interaction with GAB1, SRC, and SHC, while only Tyr 1356 is involved in the recruitment of GRB2, phospholipase C γ (PLC-γ), p85, and SHP2 (Furge et al. *Oncogene* 19: 5582-9). GAB1 is a key coordinator of the cellular responses to MET and binds the MET intracellular region with high avidity, but low affinity (Gual et al. *Oncogene* 20: 156-66). Upon interaction with MET, GAB1 becomes phosphorylated on several tyrosine residues which, in turn, recruit a number of signalling effectors, including PI3K, SHP2, and PLC-γ. GAB1 phosphorylation by MET results in a sustained signal that mediates most of the downstream signaling pathways (Gual et al. *Oncogene* 19: 1509-18).

MET engagement activates multiple signal transduction pathways:

(1) The RAS pathway mediates HGF-induced scattering and proliferation signals, which lead to branching morphogenesis (O'Brien et al. *Dev. Cell* 7: 21-32). Of note, HGF, differently from most mitogens, induces sustained RAS activation, and thus prolonged MAPK activity (Marshall C J. *Cell* 80: 179-85);

(2) The PI3K pathway is activated in two ways: PI3K can be either downstream of RAS, or it can be recruited directly through the multifunctional docking site (Graziani et al. *J. Biol. Chem.* 266: 22087-90). Activation of the PI3K pathway is currently associated with cell motility through remodeling of adhesion to the extracellular matrix as well as localized recruitment of transducers involved in cytoskeletal reorganization, such as RAC1 and PAK. PI3K activation also triggers a survival signal due to activation of the AKT pathway (Gentile et al. *Cancer Metastasis Rev.* 27: 85-94).

(3) The STAT pathway, together with the sustained MAPK activation, is necessary for the HGF-induced branching morphogenesis. MET activates the STAT3 transcription factor directly, through an SH2 domain (Boccaccio et al. *Nature* 391: 285-8).

(4) The beta-catenin pathway, a key component of the Wnt signaling pathway, translocates into the nucleus following MET activation and participates in transcriptional regulation of numerous genes (Monga et al. *Cancer Res* 7: 2064-71).

(5) The Notch pathway, through transcriptional activation of Delta ligand (Abounader et al. *Oncogene* 23: 9173-82; Gude et al. *Circ. Res.* 102: 1025-35).

In development, MET mediates a complex program known as invasive growth (Gentile et al., ibid). Activation of MET triggers mitogenesis, and morphogenesis.

MET is normally expressed by epithelial cells (Gentile et al., ibid). However, MET is also found on endothelial cells, neurons, hepatocytes, hematopoietic cells, and melanocytes. HGF expression is restricted to cells of mesenchymal origin (Boccaccio et al. Nat. Rev. Cancer 6: 637-45).

MET transcription is activated by HGF and several growth factors (Shirasaki et al. *Oncogene* 18: 7755-64). MET promoter has four putative binding sites for Ets, a family of transcription factors that control several invasive growth genes (Shirasaki et al., ibid). ETS1 activates MET transcription in vitro (Gambarotta et al. *Oncogene* 13: 1911-7). MET transcription is activated by hypoxia-inducible factor 1 (HIF1), which is activated by low concentration of intracellular oxygen (Pennacchietti et al. *Cancer Cell* 3: 347-61). HIF1 can bind to one of the several hypoxia response elements (HREs) in the MET promoter (Boccaccio et al. *Nat. Rev. Cancer* 6: 637-45). Hypoxia also activates transcription factor AP-1, which is involved in MET transcription (Boccaccio et al., ibid).

The MET pathway plays an important role in the development of cancer via:
(1) activation of key oncogenic pathways (RAS, PI3K, STAT3, beta-catenin);
(2) angiogenesis (sprouting of new blood vessels from pre-existing ones to supply a tumor with nutrients);
(3) scatter (cells dissociation due to metalloprotease production), which often leads to metastasis.

Coordinated down-regulation of both MET and its downstream effector, extracellular signal-regulated kinase 2 (ERK2), by miR-199a* may be effective in inhibiting not only cell proliferation but also motility and invasive capabilities of tumor cells (Kim et al. *J. Biol. Chem.* 283: 18158-66).

MET interacts with various tumor suppressor genes, including PTEN and VHL. PTEN (phosphatase and tensin homolog) is a tumor suppressor gene encoding a protein PTEN, which possesses lipid and protein phosphatase-dependent as well as phosphatase-independent activities (Maehama and Dixon. *J. Biol. Chem.* 273: 13375-8). PTEN protein phosphatase is able to interfere with MET signaling by dephosphorylating either PIP3 generated by PI3K, or the p52 isoform of SHC. S HC dephosphorylation inhibits recruitment of the GRB2 adapter to activated MET (Abounader et al. *Oncogene* 23: 9173-82). Meanwhile, there is evidence of correlation between inactivation of VHL tumor suppressor gene and increased MET signaling in renal cell carcinoma (RCC; Morris et al. *Cancer Res.* 65: 4598-606).

A number of cancer therapeutics have been designed to inhibit MET activity, including:

MET kinase inhibitors. Kinase inhibitors are low molecular weight molecules that prevent ATP binding to MET, thus inhibiting receptor transphosphorylation and recruitment of the downstream effectors. The limitations of kinase inhibitors include the fact that they only inhibit kinase-dependent MET activation, and that none of them is fully specific for MET.

(1) K252a (Fermentek Biotechnology), a staurosporine analogue isolated from *Nocardiopsis* sp. soil fungi, which is a potent inhibitor of all receptor tyrosine kinases (RTKs). At nanomolar concentrations, K252a inhibits both the wild type and the mutant (M1268T) MET function (Morotti et al. *Oncogene* 21: 4885-93).

(2) SU11274 (SUGEN) specifically inhibits MET kinase activity and its subsequent signaling. SU11274 is also an effective inhibitor of the M1268T and H1112Y MET mutants, but not the L1213V and Y1248H mutants (Berthou et al. *Oncogene* 23: 5387-93). SU11274 has been demonstrated to inhibit HGF-induced motility and invasion of epithelial and carcinoma cells (Wang et al. *Mol. Cancer. Ther.* 2: 1085-92).

(3) PHA-665752 (Pfizer) specifically inhibits MET kinase activity, and it has been demonstrated to represses both HGF-dependent and constitutive MET phosphorylation (Christensen et al. *Cancer Res.* 63: 7345-55). Furthermore, some tumors harboring MET amplifications are highly sensitive to treatment with PHA-665752 (Smolen et al. *Proc. Natl. Acad. Sci. U.S.A.* 103: 2316-21).

(4) ARQ197 (ArQule) is a selective inhibitor of MET, which entered a phase 2 clinical trial in 2008.

(5) Foretinib (XL880, Exelixis) targets multiple receptor tyrosine kinases (RTKs) with growth-promoting and angiogenic properties. The primary targets of foretinib are MET, VEGFR2, and KDR. Foretinib has completed a phase 2 clinical trials with indications for papillary renal cell carcinoma, gastric cancer, and head and neck cancer.

(6) SGX523 (SGX Pharmaceuticals) specifically inhibits MET at low nanomolar concentrations.

(7) MP470 (SuperGen) is an inhibitor of c-KIT, MET, PDGFR, Flt3, and AXL. Phase I clinical trial of MP470 was announced in 2007.

HGF inhibitors. Since HGF is the only known ligand of MET, formation of a HGF:MET complex blocks MET biological activity. For this reason, truncated HGF, anti-HGF neutralizing antibodies, and an uncleavable form of HGF have been utilized in pharmaceutical development efforts. The major limitation of HGF inhibitors is that they block only HGF-dependent MET activation.

(1) NK4 competes with HGF as it binds MET without inducing receptor activation, thus behaving as a full antagonist. NK4 is a molecule bearing the N-terminal hairpin and the four kringle domains of HGF. Moreover, NK4 is structurally similar to angiostatins, which is why it possesses anti-angiogenic activity (Matsumoto and Nakamura. Cancer Sci. 94: 321-7).

(2) Neutralizing anti-HGF antibodies were initially tested in combination, and it was shown that at least three antibodies, acting on different HGF epitopes, were necessary to prevent MET tyrosine kinase activation (Cao et al. *Proc. Natl. Acad. Sci. U.S.A.* 98: 7443-8). More recently, fully human monoclonal antibodies were demonstrated individually to bind and neutralize human HGF, leading to regression of tumors in mouse models (Burgess et al. *Cancer Res.* 66: 1721-9). Two anti-HGF antibodies are currently in use: the humanized AV299 (AVEO), and the fully human AMG102 (Amgen).

(3) Uncleavable HGF is an engineered form of pro-HGF carrying a single amino-acid substitution, which prevents the maturation of the molecule. Uncleavable HGF is capable of blocking MET-induced biological responses by binding MET with high affinity and displacing mature HGF. Moreover, uncleavable HGF competes with the wild-type endogenous pro-HGF for the catalytic domain of proteases that cleave HGF precursors. Local and systemic expression of uncleavable HGF inhibits tumor growth and also prevents metastasis (Mazzone et al. *J. Clin. Invest.* 114: 1418-32).

Decoy MET. Decoy MET refers to a soluble truncated MET receptor. Decoys are able to inhibit MET activation mediated by both HGF-dependent and independent mechanisms, as decoys prevent both the ligand binding and the MET receptor homodimerization. CGEN241 (Compugen) is a decoy MET that is highly efficient in inhibiting tumor growth and preventing metastasis in animal models (Michieli et al. *Cancer Cell* 6: 61-73).

Immunotherapy targeting MET. Drugs used for immunotherapy can act either passively by enhancing the immunologic response to MET-expressing tumor cells, or actively by stimulating immune cells and altering differentiation/growth of tumor cells (Reang et al. *Med Gen Med* 8: 33).

Passive immunotherapy. Administering monoclonal antibodies (mAbs) is a form of passive immunotherapy. mAbs facilitate destruction of tumor cells by complement-dependent cytotoxicity (CDC) and cell-mediated cytotoxicity (ADCC). In CDC, mAbs bind to specific antigen, leading to activation of the complement cascade, which in turn leads to formation of pores in tumor cells. In ADCC, the Fab domain of a mAb binds to a tumor antigen, and Fc domain binds to Fc receptors present on effector cells (phagocytes and NK cells), thus forming a bridge between an effector and a target cells. This induces the effector cell activation, leading to phagocytosis of the tumor cell by neutrophils and macrophages. Furthermore, NK cells release cytotoxic molecules, which lyse tumor cells (Reang et al. *Med Gen Med* 8: 33).

(1) DN30 is monoclonal anti-MET antibody that recognizes the extracellular portion of MET. DN30 induces both shedding of the MET ectodomain as well as cleavage of the intracellular domain, which is successively degraded by proteasome machinery. As a consequence, on one side MET is inactivated, and on the other side the shed portion of extracellular MET hampers activation of other MET receptors, acting as a decoy. DN30 inhibits tumour growth and prevents metastasis in animal models (Petrelli et al. *Proc. Natl. Acad. Sci. U.S.A.* 103: 5090-5).

(2) OA-5D5 is a one-armed monoclonal anti-MET antibody that was demonstrated to inhibit orthotopic pancreatic (Jin et al. *Cancer Res.* 68: 4360-8) and glioblastoma (Martens et al. *Clin. Cancer Res.* 12: 6144-52) tumor growth and to improve survival in tumor xenograft models. OA-5D5 is produced as a recombinant protein in *Escherichia coli*. It is composed of murine variable domains for the heavy and light chains, with human IgG1 constant domains. The antibody blocks HGF binding to MET in a competitive fashion.

Active immunotherapy. Active immunotherapy to MET-expressing tumors can be achieved by administering cytokines, such as interferons (IFNs) and interleukins (IL-2), which triggers non-specific stimulation of numerous immune cells. IFNs have been tested as therapies for many types of cancers and have demonstrated therapeutic benefits. IL-2 was approved by the U.S. Food and Drug Administration (FDA) for the treatment of renal cell carcinoma and metastatic melanoma, which often have deregulated MET activity (Reang et al. *Med Gen Med* 8: 33).

The MET-inhibiting double stranded nucleic acids of the instant invention can be used alone, or in combination with any art-recognized MET-targeting therapeutic, such as those recited above.

Pharmaceutical Compositions

In certain embodiments, the present invention provides for a pharmaceutical composition comprising the dsRNA agent of the present invention. The dsRNA agent sample can be suitably formulated and introduced into the environment of the cell by any means that allows for a sufficient portion of the sample to enter the cell to induce gene silencing, if it is to occur. Many formulations for dsRNA are known in the art and can be used so long as the dsRNA gains entry to the target cells so that it can act. See, e.g., U.S. published patent application Nos. 2004/0203145 A1 and 2005/0054598 A1. For example, the dsRNA agent of the instant invention can be formulated in buffer solutions such as phosphate buffered saline solutions, liposomes, micellar structures, and capsids. Formulations of dsRNA agent with cationic lipids can be used to facilitate transfection of the dsRNA agent into cells. For example, cationic lipids, such as lipofectin (U.S. Pat. No. 5,705,188), cationic glycerol derivatives, and polycationic molecules, such as polylysine (published PCT International Application WO 97/30731), can be used. Suitable lipids include Oligofectamine, Lipofectamine (Life Technologies), NC388 (Ribozyme Pharmaceuticals, Inc., Boulder, Colo.), or FuGene 6 (Roche) all of which can be used according to the manufacturer's instructions.

Such compositions typically include the nucleic acid molecule and a pharmaceutically acceptable carrier. As used herein the language "pharmaceutically acceptable carrier" includes saline, solvents, dispersion media, coatings, antibacterial and antifungal agents, isotonic and absorption delaying agents, and the like, compatible with pharmaceutical administration. Supplementary active compounds can also be incorporated into the compositions.

A pharmaceutical composition is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; cHeLating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringability exists. It should be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in a selected solvent with one or a combination of ingredients enumerated above, as required, followed by filtered sterilization. Generally, dispersions are prepared by incorporating the active compound into a sterile vehicle, which contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. For the purpose of oral therapeutic administration, the active compound can be incorporated with excipients and used in the form of tablets, troches, or capsules, e.g., gelatin capsules. Oral compositions can also be prepared using a fluid carrier for use as a mouthwash. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer. Such methods include those described in U.S. Pat. No. 6,468,798.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

The compounds can also be administered by transfection or infection using methods known in the art, including but not limited to the methods described in McCaffrey et al. (2002), Nature, 418(6893), 38-9 (hydrodynamic transfection); Xia et al. (2002), Nature Biotechnol., 20(10), 1006-10 (viral-mediated delivery); or Putnam (1996), Am. J. Health Syst. Pharm. 53(2), 151-160, erratum at Am. J. Health Syst. Pharm. 53(3), 325 (1996).

The compounds can also be administered by a method suitable for administration of nucleic acid agents, such as a DNA vaccine. These methods include gene guns, bio injectors, and skin patches as well as needle-free methods such as the micro-particle DNA vaccine technology disclosed in U.S. Pat. No. 6,194,389, and the mammalian transdermal needle-free vaccination with powder-form vaccine as disclosed in U.S. Pat. No. 6,168,587. Additionally, intranasal delivery is possible, as described in, inter alia, Hamajima et al. (1998), Clin. Immunol. Immunopathol., 88(2), 205-10. Liposomes (e.g., as described in U.S. Pat. No. 6,472,375) and microencapsulation can also be used. Biodegradable targetable microparticle delivery systems can also be used (e.g., as described in U.S. Pat. No. 6,471,996).

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Such formulations can be prepared using standard techniques. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds which exhibit high therapeutic indices are preferred. While compounds that exhibit toxic side effects may be used, care should be taken to design a delivery system that targets such compounds to the site of affected tissue in order to minimize potential damage to uninfected cells and, thereby, reduce side effects.

The data obtained from the cell culture assays and animal studies can be used in formulating a range of dosage for use in humans. The dosage of such compounds lies preferably within a range of circulating concentrations that include the $ED_{50}$ with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range that includes the $IC_{50}$ (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

As defined herein, a therapeutically effective amount of a nucleic acid molecule (i.e., an effective dosage) depends on the nucleic acid selected. For instance, single dose amounts of a dsRNA (or, e.g., a construct(s) encoding for such dsRNA) in the range of approximately 1 pg to 1000 mg may be administered; in some embodiments, 10, 30, 100, or 1000 pg, or 10, 30, 100, or 1000 ng, or 10, 30, 100, or 1000 µg, or 10, 30, 100, or 1000 mg may be administered. In some embodiments, 1-5 g of the compositions can be administered. The compositions can be administered one from one or more times per day to one or more times per week; including once every other day. The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a nucleic acid (e.g., dsRNA), protein, polypeptide, or antibody can include a single treatment or, preferably, can include a series of treatments.

The nucleic acid molecules of the invention can be inserted into expression constructs, e.g., viral vectors, retroviral vectors, expression cassettes, or plasmid viral vectors, e.g., using methods known in the art, including but not limited to those described in Xia et al., (2002), supra. Expression constructs can be delivered to a subject by, for example, inhalation, orally, intravenous injection, local administration (see U.S. Pat. No. 5,328,470) or by stereotactic injection (see e.g., Chen et al. (1994), Proc. Natl. Acad. Sci. USA, 91, 3054-3057). The pharmaceutical preparation of the delivery vector can include the vector in an acceptable diluent, or can comprise a slow release matrix in which the delivery vehicle is imbedded. Alternatively, where the complete delivery vector can be produced intact from recombinant cells, e.g., retroviral vectors, the pharmaceutical preparation can include one or more cells which produce the gene delivery system.

The expression constructs may be constructs suitable for use in the appropriate expression system and include, but are not limited to retroviral vectors, linear expression cassettes, plasmids and viral or virally-derived vectors, as known in the art. Such expression constructs may include one or more inducible promoters, RNA Pol III promoter systems such as U6 snRNA promoters or H1 RNA polymerase III promoters, or other promoters known in the art. The constructs can include one or both strands of the siRNA. Expression constructs expressing both strands can also include loop structures linking both strands, or each strand can be separately transcribed from separate promoters within the same construct. Each strand can also be transcribed from a separate expression construct, e.g., Tuschl (2002, *Nature Biotechnol* 20: 500-505).

It can be appreciated that the method of introducing dsRNA agents into the environment of the cell will depend on the type of cell and the make up of its environment. For example, when the cells are found within a liquid, one preferable formulation is with a lipid formulation such as in lipofectamine and the dsRNA agents can be added directly to the liquid environment of the cells. Lipid formulations can also be administered to animals such as by intravenous, intramuscular, or intraperitoneal injection, or orally or by inhalation or other methods as are known in the art. When the formulation is suitable for administration into animals such as mammals and more specifically humans, the formulation is also pharmaceutically acceptable. Pharmaceutically acceptable formulations for administering oligonucleotides are known and can be used. In some instances, it may be preferable to formulate dsRNA agents in a buffer or saline solution and directly inject the formulated dsRNA agents into cells, as in studies with oocytes. The direct injection of dsRNA agent duplexes may also be done. For suitable methods of introducing dsRNA (e.g., DsiRNA agents), see U.S. published patent application No. 2004/0203145 A1.

Suitable amounts of a dsRNA agent must be introduced and these amounts can be empirically determined using standard methods. Typically, effective concentrations of individual dsRNA agent species in the environment of a cell will be 50 nanomolar or less, 10 nanomolar or less, or compositions in which concentrations of 1 nanomolar or less can be used. In another embodiment, methods utilizing a concentration of 200 picomolar or less, 100 picomolar or less, 50 picomolar or less, 20 picomolar or less, and even a concentration of 10 picomolar or less, 5 picomolar or less, 2 picomolar or less or 1 picomolar or less can be used in many circumstances.

The method can be carried out by addition of the dsRNA agent compositions to an extracellular matrix in which cells can live provided that the dsRNA agent composition is formulated so that a sufficient amount of the dsRNA agent can enter the cell to exert its effect. For example, the method is amenable for use with cells present in a liquid such as a liquid culture or cell growth media, in tissue explants, or in whole organisms, including animals, such as mammals and especially humans.

The level or activity of a MET RNA can be determined by a suitable method now known in the art or that is later developed. It can be appreciated that the method used to measure a target RNA and/or the expression of a target RNA can depend upon the nature of the target RNA. For example, where the target MET RNA sequence encodes a protein, the term "expression" can refer to a protein or the MET RNA/transcript derived from the MET gene (either genomic or of exogenous origin). In such instances the expression of the target MET RNA can be determined by measuring the amount of MET RNA/transcript directly or by measuring the amount of MET protein. Protein can be measured in protein assays such as by staining or immunoblotting or, if the protein catalyzes a reaction that can be measured, by measuring reaction rates. All such methods are known in the art and can be used. Where target MET RNA levels are to be measured, art-recognized methods for detecting RNA levels can be used (e.g., RT-PCR, Northern Blotting, etc.). In targeting MET RNAs with the dsRNA agents of the instant invention, it is also anticipated that measurement of the efficacy of a dsRNA agent in reducing levels of MET RNA or protein in a subject, tissue, in cells, either in vitro or in vivo, or in cell extracts can also be used to determine the extent of reduction of MET-associated phenotypes (e.g., disease or disorders, e.g., cancer or tumor formation, growth, metastasis, spread, etc.). The above measurements can be made on cells, cell extracts, tissues, tissue extracts or other suitable source material.

The determination of whether the expression of a MET RNA has been reduced can be by a suitable method that can reliably detect changes in RNA levels. Typically, the determination is made by introducing into the environment of a cell undigested dsRNA such that at least a portion of that dsRNA agent enters the cytoplasm, and then measuring the level of the target RNA. The same measurement is made on identical untreated cells and the results obtained from each measurement are compared.

The dsRNA agent can be formulated as a pharmaceutical composition which comprises a pharmacologically effective amount of a dsRNA agent and pharmaceutically acceptable carrier. A pharmacologically or therapeutically effective amount refers to that amount of a dsRNA agent effective to produce the intended pharmacological, therapeutic or preventive result. The phrases "pharmacologically effective amount" and "therapeutically effective amount" or simply "effective amount" refer to that amount of an RNA effective to produce the intended pharmacological, therapeutic or preventive result. For example, if a given clinical treatment is considered effective when there is at least a 20% reduction in a measurable parameter associated with a disease or disorder, a therapeutically effective amount of a drug for the treatment of that disease or disorder is the amount necessary to effect at least a 20% reduction in that parameter.

Suitably formulated pharmaceutical compositions of this invention can be administered by means known in the art such as by parenteral routes, including intravenous, intramuscular, intraperitoneal, subcutaneous, transdermal, airway (aerosol), rectal, vaginal and topical (including buccal and sublingual) administration. In some embodiments, the pharmaceutical compositions are administered by intravenous or intraparenteral infusion or injection.

In general, a suitable dosage unit of dsRNA will be in the range of 0.001 to 0.25 milligrams per kilogram body weight of the recipient per day, or in the range of 0.01 to 20 micrograms per kilogram body weight per day, or in the range of 0.001 to 5 micrograms per kilogram of body weight per day, or in the range of 1 to 500 nanograms per kilogram of body weight per day, or in the range of 0.01 to 10 micrograms per kilogram body weight per day, or in the range of 0.10 to 5 micrograms per kilogram body weight per day, or in the range of 0.1 to 2.5 micrograms per kilogram body weight per day. A pharmaceutical composition comprising the dsRNA can be administered once daily. However, the therapeutic agent may also be dosed in dosage units containing two, three, four, five, six or more sub-doses administered at appropriate intervals throughout the day. In that case, the dsRNA contained in each sub-dose must be correspondingly smaller in order to achieve the total daily dosage unit. The dosage unit can also be compounded for a single dose over several days, e.g., using a conventional sustained release formulation which provides sustained and consistent release of the dsRNA over a several day period. Sustained release formulations are well known in the art. In this embodiment, the dosage unit contains a corresponding multiple of the daily dose. Regardless of the formulation, the pharmaceutical composition must contain dsRNA in a quantity sufficient to inhibit expression of the target gene in the animal or human being treated. The composition can be compounded in such a way that the sum of the multiple units of dsRNA together contain a sufficient dose.

Data can be obtained from cell culture assays and animal studies to formulate a suitable dosage range for humans. The dosage of compositions of the invention lies within a range of circulating concentrations that include the $ED_{50}$ (as determined by known methods) with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range of the compound that includes the $IC_{50}$ (i.e., the concentration of the test compound which achieves a half-maximal inhibition of symptoms) as determined in cell culture. Such information can be used to more accurately determine useful doses in humans. Levels of dsRNA in plasma may be measured by standard methods, for example, by high performance liquid chromatography.

The pharmaceutical compositions can be included in a kit, container, pack, or dispenser together with instructions for administration.

Methods of Treatment

The present invention provides for both prophylactic and therapeutic methods of treating a subject at risk of (or susceptible to) a disease or disorder caused, in whole or in part, by MET (e.g., misregulation and/or elevation of MET transcript and/or MET protein levels), or treatable via selective targeting of MET.

"Treatment", or "treating" as used herein, is defined as the application or administration of a therapeutic agent (e.g., a dsRNA agent or vector or transgene encoding same) to a patient, or application or administration of a therapeutic agent to an isolated tissue or cell line from a patient, who has the disease or disorder, a symptom of disease or disorder or a predisposition toward a disease or disorder, with the purpose to cure, heal, alleviate, relieve, alter, remedy, ameliorate, improve or affect the disease or disorder, the symptoms of the disease or disorder, or the predisposition toward disease.

In one aspect, the invention provides a method for preventing in a subject, a disease or disorder as described above (including, e.g., prevention of the commencement of transforming events within a subject via inhibition of MET expression), by administering to the subject a therapeutic agent (e.g., a dsRNA agent or vector or transgene encoding same). Subjects at risk for the disease can be identified by, for example, one or a combination of diagnostic or prognostic assays as described herein. Administration of a prophylactic agent can occur prior to the detection of, e.g., cancer in a subject, or the manifestation of symptoms characteristic of the disease or disorder, such that the disease or disorder is prevented or, alternatively, delayed in its progression.

Another aspect of the invention pertains to methods of treating subjects therapeutically, i.e., altering the onset of symptoms of the disease or disorder. These methods can be performed in vitro (e.g., by culturing the cell with the dsRNA agent) or, alternatively, in vivo (e.g., by administering the dsRNA agent to a subject).

With regards to both prophylactic and therapeutic methods of treatment, such treatments may be specifically tailored or modified, based on knowledge obtained from the field of pharmacogenomics. "Pharmacogenomics", as used herein, refers to the application of genomics technologies such as gene sequencing, statistical genetics, and gene expression analysis to drugs in clinical development and on the market. More specifically, the term refers the study of how a patient's genes determine his or her response to a drug (e.g., a patient's "drug response phenotype", or "drug response genotype"). Thus, another aspect of the invention provides methods for tailoring an individual's prophylactic or therapeutic treatment with either the target MET RNA molecules of the present invention or target MET RNA modulators according to that individual's drug response genotype. Pharmacogenomics allows a clinician or physician to target prophylactic or therapeutic treatments to patients who will most benefit from the treatment and to avoid treatment of patients who will experience toxic drug-related side effects.

Therapeutic agents can be tested in a selected animal model. For example, a dsRNA agent (or expression vector or transgene encoding same) as described herein can be used in an animal model to determine the efficacy, toxicity, or side effects of treatment with said agent. Alternatively, an agent (e.g., a therapeutic agent) can be used in an animal model to determine the mechanism of action of such an agent.

Models Useful to Evaluate the Down-Regulation of MET mRNA Levels and Expression

Cell Culture

The dsRNA agents of the invention can be tested for cleavage activity in vivo, for example, using the following procedure. The nucleotide sequences within the MET cDNA targeted by the dsRNA agents of the invention are shown in the above MET sequences.

The dsRNA reagents of the invention can be tested in cell culture using HeLa or other mammalian cells to determine the extent of MET RNA and MET protein inhibition. In certain embodiments, DsiRNA reagents (e.g., see FIG. 1, and above-recited structures) are selected against the MET target as described herein. MET RNA inhibition is measured after delivery of these reagents by a suitable transfection agent to, for example, cultured HeLa cells or other transformed or non-transformed mammalian cells in culture. Relative amounts of target MET RNA are measured versus actin or other appropriate control using real-time PCR monitoring of amplification (e.g., ABI 7700 TAQMAN®). A comparison is made to a mixture of oligonucleotide sequences made to unrelated targets or to a randomized DsiRNA control with the same overall length and chemistry, but randomly substituted at each position, or simply to appropriate vehicle-treated or untreated controls. Primary and secondary lead reagents are chosen for the target and optimization performed. After a transfection agent concentration is chosen, a RNA time-course of inhibition is performed with the lead DsiRNA molecule.

TAQMAN® (Real-Time PCR Monitoring of Amplification) and Lightcycler Quantification of mRNA Total RNA is prepared from cells following DsiRNA delivery, for example, using Ambion Rnaqueous 4-PCR purification kit for large scale extractions, or Promega SV96 for 96-well assays. For Taqman analysis, dual-labeled probes are synthesized with, for example, the reporter dyes FAM or VIC covalently linked at the 5'-end and the quencher dye TAMMETA conjugated to the 3'-end. PCR amplifications are performed on, for example, an ABI PRISM 7700 Sequence detector using 50 uL reactions consisting of 10 uL total RNA, 100 nM forward primer, 100 mM reverse primer, 100 nM probe, 1×TaqMan PCR reaction buffer (PE-Applied Biosystems), 5.5 mM MgCl2, 100 uM each dATP, dCTP, dGTP and dTTP, 0.2U RNase Inhibitor (Promega), 0.025U AmpliTaq Gold (PE-Applied Biosystems) and 0.2U M-MLV Reverse Transcriptase (Promega). The thermal cycling conditions can consist of 30 minutes at 48° C., 10 minutes at 95° C., followed by 40 cycles of 15 seconds at 95° C. and 1 minute at 60° C. Quantitation of target MET mRNA level is determined relative to standards generated from serially diluted total cellular RNA (300, 100, 30, 10 ng/rxn) and normalizing to, for example, 36B4 mRNA in either parallel or same tube TaqMan reactions.

Western Blotting

Cellular protein extracts can be prepared using a standard micro preparation technique (for example using RIPA buffer), or preferably, by extracting nuclear proteins by a method such as the NE-PER Nuclear and Cytoplasmic Extraction kit (Thermo-Fisher Scientific). Cellular protein extracts are run on 4-12% Tris-Glycine polyacrylamide gel and transferred onto membranes. Non-specific binding can be blocked by incubation, for example, with 5% non-fat milk for 1 hour followed by primary antibody for 16 hours at 4° C. Following washes, the secondary antibody is applied, for example (1:10,000 dilution) for 1 hour at room temperature and the signal detected on a VersaDoc imaging system In several cell culture systems, cationic lipids have been shown to enhance the bioavailability of oligonucleotides to cells in culture (Bennet, et al., 1992, Mol. Pharmacology, 41, 1023-1033). In one embodiment, dsRNA molecules of the invention are complexed with cationic lipids for cell culture experiments. dsRNA and cationic lipid mixtures are prepared in serum-free OptimMEM (InVitrogen) immediately prior to addition to the cells. OptiMEM is warmed to room temperature (about 20-25° C.) and cationic lipid is added to the final desired concentration. dsRNA molecules are added to OptiMEM to the desired concentration and the solution is added to the diluted dsRNA and incubated for 15 minutes at room temperature. In dose response experiments, the RNA complex is serially diluted into OptiMEM prior to addition of the cationic lipid.

Animal Models

The efficacy of anti-MET dsRNA agents may be evaluated in an animal model. Animal models of cancer and/or proliferative diseases, conditions, or disorders as are known in the art can be used for evaluation of the efficacy, potency, toxicity, etc. of anti-MET dsRNAs. Suitable animal models of proliferative disease include, e.g., transgenic rodents (e.g., mice, rats) bearing gain of function proto-oncogenes (e.g., Myc, Src) and/or loss of function of tumour suppressor proteins (e.g., p53, Rb) or rodents that have been exposed to radiation or chemical mutagens that induce DNA changes that facilitate neoplastic transformation. Many such animal models are commercially available, for example, from The Jackson Laboratory, Bar Harbor, Me., USA. These animal models may be used as a source cells or tissue for assays of the compositions of the invention. Such models can also be used or adapted for use for pre-clinical evaluation of the efficacy of dsRNA compositions of the invention in modulating MET gene expression toward therapeutic use.

As in cell culture models, the most MET relevant mouse tumor xenografts are those derived from cancer cells that express MET proteins. Xenograft mouse models of cancer relevant to study of the anti-tumor effect of modulating MET have been described by various groups (e.g., Zhang et al., *Mol Cancer Ther* 2005 4: 1577-1584; Tang et al., *Br J Cancer* 2008 99: 911-922; Yakes et al., *Mol Cancer Ther* 2011 Sep. 16 (ePub; Munshi et al., *Mol Cancer Ther* 2010 9: 1544-1553). Use of these models has demonstrated that inhibition of MET expression by anti-MET agents causes inhibition of tumor growth in animals.

Such models can be used in evaluating the efficacy of dsRNA molecules of the invention to inhibit MET levels, expression, tumor/cancer formation, growth, spread, development of other MET-associated phenotypes, diseases or disorders, etc. These models and others can similarly be used to evaluate the safety/toxicity and efficacy of dsRNA molecules of the invention in a pre-clinical setting.

Specific examples of animal model systems useful for evaluation of the MET-targeting dsRNAs of the invention include wild-type mice, and orthotopic or subcutaneous MHCC97, NCI-H1975, HT29, MKN-45, MDA-MB-231, NCI-H441, Panc-1, MiaPaCa, DU-145, OvCar-3, MCF-7, or SHP-77 tumor model mice. In an exemplary in vivo experiment, dsRNAs of the invention are tail vein injected into such mouse models at doses ranging from 1 to 10 mg/kg or, alternatively, repeated doses are administered at single-dose $IC_{50}$ levels, and organs (e.g., prostate, liver, kidney, lung, pancreas, colon, skin, spleen, bone marrow, lymph nodes, mammary fat pad, etc.) are harvested 24 hours after administration of the final dose. Such organs are then evaluated for mouse and/or human MET levels, depending upon the model used. Duration of action can also be examined at, e.g., 1, 4, 7, 14, 21 or more days after final dsRNA administration.

The practice of the present invention employs, unless otherwise indicated, conventional techniques of chemistry, molecular biology, microbiology, recombinant DNA, genetics, immunology, cell biology, cell culture and transgenic biology, which are within the skill of the art. See, e.g., Maniatis et al., 1982, Molecular Cloning (Cold Spring Harbor Laboratory Press, Cold Spring Harbor, N.Y.); Sambrook et al., 1989, Molecular Cloning, 2nd Ed. (Cold Spring Harbor Laboratory Press, Cold Spring Harbor, N.Y.); Sambrook and Russell, 2001, Molecular Cloning, 3rd Ed. (Cold Spring Harbor Laboratory Press, Cold Spring Harbor, N.Y.); Ausubel et al., 1992), Current Protocols in Molecular Biology (John Wiley & Sons, including periodic updates); Glover, 1985, DNA Cloning (IRL Press, Oxford); Anand, 1992; Guthrie and Fink, 1991; Harlow and Lane, 1988, Antibodies, (Cold Spring Harbor Laboratory Press, Cold Spring Harbor, N.Y.); Jakoby and Pastan, 1979; Nucleic Acid Hybridization (B. D. Hames & S. J. Higgins eds. 1984); Transcription And Translation (B. D. Hames & S. J. Higgins eds. 1984); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the treatise, Methods In Enzymology (Academic Press, Inc., N.Y.); Gene Transfer Vectors For Mammalian Cells (J. H. Miller and M. P. Calos eds., 1987, Cold Spring Harbor Laboratory); Methods In Enzymology, Vols. 154 and 155 (Wu et al. eds.), Immunochemical Methods In Cell And Molecular Biology (Mayer and Walker, eds., Academic Press, London, 1987); Handbook Of Experimental Immunology, Volumes I-IV (D. M. Weir and C. C. Blackwell, eds., 1986); Riott, Essential Immunology, 6th Edition, Blackwell Scientific Publications, Oxford, 1988; Hogan et al., Manipulating the Mouse Embryo, (Cold Spring Harbor Laboratory Press, Cold Spring Harbor, N.Y., 1986); Westerfield, M., The zebrafish book. A guide for the laboratory use of zebrafish (Danio rerio), (4th Ed., Univ. of Oregon Press, Eugene, 2000).

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

The present invention is described by reference to the following Examples, which are offered by way of illustration and are not intended to limit the invention in any manner. Standard techniques well known in the art or the techniques specifically described below were utilized.

Example 1

Preparation of Double-Stranded RNA Oligonucleotides

Oligonucleotide Synthesis and Purification

DsiRNA molecules can be designed to interact with various sites in the RNA message, for example, target sequences within the RNA sequences described herein. In presently exemplified agents, 378 human target MET sequences and 72 mouse target MET sequences were selected for evaluation (258 of the 378 human target MET sites were predicted to be conserved with corresponding sites in the mouse MET transcript sequence). The sequences of one strand of the DsiRNA molecules were complementary to the target MET site sequences described above. The DsiRNA molecules were chemically synthesized using methods described herein. Generally, DsiRNA constructs were synthesized using solid phase oligonucleotide synthesis methods as described for 19-23mer siRNAs (see for example Usman et al., U.S. Pat. Nos. 5,804,683; 5,831,071;

5,998,203; 6,117,657; 6,353,098; 6,362,323; 6,437,117; 6,469,158; Scaringe et al., U.S. Pat. Nos. 6,111,086; 6,008,400; 6,111,086).

Individual RNA strands were synthesized and HPLC purified according to standard methods (Integrated DNA Technologies, Coralville, Iowa). For example, RNA oligonucleotides were synthesized using solid phase phosphoramidite chemistry, deprotected and desalted on NAP-5 columns (Amersham Pharmacia Biotech, Piscataway, N.J.) using standard techniques (Damha and Olgivie, 1993, *Meth-ods Mol Biol* 20: 81-114; Wincott et al., 1995, *Nucleic Acids Res* 23: 2677-84). The oligomers were purified using ion-exchange high performance liquid chromatography (IE-HPLC) on an Amersham Source 15Q column (1.0 cm×25 cm; Amersham Pharmacia Biotech, Piscataway, N.J.) using a 15 min step-linear gradient. The gradient varies from 90:10 Buffers A:B to 52:48 Buffers A:B, where Buffer A is 100 mM Tris pH 8.5 and Buffer B is 100 mM Tris pH 8.5, 1 M NaCl. Samples were monitored at 260 nm and peaks corresponding to the full-length oligonucleotide species are collected, pooled, desalted on NAP-5 columns, and lyophilized.

The purity of each oligomer was determined by capillary electrophoresis (CE) on a Beckman PACE 5000 (Beckman Coulter, Inc., Fullerton, Calif.). The CE capillaries had a 100 μm inner diameter and contains ssDNA 100R Gel (Beckman-Coulter). Typically, about 0.6 nmole of oligonucleotide was injected into a capillary, run in an electric field of 444 V/cm and detected by UV absorbance at 260 nm. Denaturing Tris-Borate-7 M-urea running buffer was purchased from Beckman-Coulter. Oligoribonucleotides were obtained that are at least 90% pure as assessed by CE for use in experiments described below. Compound identity was verified by matrix-assisted laser desorption ionization time-of-flight (MALDI-TOF) mass spectroscopy on a Voyager DE™ Biospectometry Work Station (Applied Biosystems, Foster City, Calif.) following the manufacturer's recommended protocol. Relative molecular masses of all oligomers were obtained, often within 0.2% of expected molecular mass.

Preparation of Duplexes

Single-stranded RNA (ssRNA) oligomers were resuspended, e.g., at 100 μM concentration in duplex buffer consisting of 100 mM potassium acetate, 30 mM HEPES, pH 7.5. Complementary sense and antisense strands were mixed in equal molar amounts to yield a final solution of, e.g., 50 μM duplex. Samples were heated to 100° C. for 5' in RNA buffer (IDT) and allowed to cool to room temperature before use. Double-stranded RNA (dsRNA) oligomers were stored at −20° C. Single-stranded RNA oligomers were stored lyophilized or in nuclease-free water at −80° C.

Nomenclature

For consistency, the following nomenclature has been employed in the instant specification. Names given to duplexes indicate the length of the oligomers and the presence or absence of overhangs. A "25/27" is an asymmetric duplex having a 25 base sense strand and a 27 base antisense strand with a 2-base 3'-overhang. A "27/25" is an asymmetric duplex having a 27 base sense strand and a 25 base antisense strand.

Cell culture and RNA Transfection

HeLa cells were obtained from ATCC and maintained in DMEM (HyClone) supplemented with 10% fetal bovine serum (HyClone) at 37° C. under 5% $CO_2$. HEPA1-6 cells were obtained from ATCC and maintained in DMEM (HyClone) supplemented with 10% fetal bovine serum (HyClone) at 37° C. under 5% $CO_2$. For RNA transfections, cells were transfected with DsiRNAs as indicated at a final concentration of 1 nM, 0.3 nM or 0.1 nM using Lipofectamine™ RNAiMAX (Invitrogen) and following manufacturer's instructions. Briefly, for 0.1 nM transfections, e.g., of Example 8 below, an aliquot of stock solution of each DsiRNA was mixed with Opti-MEM I (Invitrogen) and Lipofectamine™ RNAiMAX to reach a volume of 200 μL. The resulting 200 μL mix was added per well into duplicate individual wells of 24 well plates and incubated for 20 min at RT to allow DsiRNA:Lipofectamine™ RNAiMAX complexes to form. Meanwhile, target cells were trypsinized and resuspended in medium. Finally, 300 μL of the cell suspension were added to each well (final volume 500 μL) and plates were placed into the incubator for 24 hours.

Assessment of MET Inhibition

MET target gene knockdown was determined by qRT-PCR, with values normalized to HPRT and SFRS9 housekeeping genes (or, in Example 8 below, to HPRT only), and to transfections with control DsiRNAs and/or mock transfection controls.

RNA Isolation and Analysis

Media was aspirated, and total RNA was extracted using the SV96 kit (Promega). Approximately 100 ng of total RNA was reverse-transcribed using SuperscriptII, Oligo dT, and random hexamers following manufacturer's instructions. Typically, one-sixth of the resulting cDNA was analyzed by qPCR using primers and probes specific for both the MET gene and for the human genes HPRT-1 and SFRS9. An ABI 7700 was used for the amplification reactions. Each sample was tested in triplicate. Relative MET RNA levels were normalized to HPRT1 and SFRS9 RNA levels and compared with RNA levels obtained in mock transfection control samples. For Example 8 below, approximately 200 ng of total RNA was reverse-transcribed using Transcriptor First Strand cDNA Synthesis Kit (Roche) and random hexamers following manufacturer's instructions. Typically, on-fifteenth of the resulting cDNA was analyzed by qPCR using primers and probes specific for both the MET gene and for the human gene HPRT-1. A Bio-Rad CFX96 was used for the amplification reactions. Each sample was tested in duplicate. Relative MET RNA levels were normalized to HPRT1 RNA levels and compared with RNA levels obtained in mock transfection control samples.

Example 2

DsiRNA Inhibition of MET—Primary Screen

DsiRNA molecules targeting MET were designed and synthesized as described above and tested in HeLa cells for inhibitory efficacy. For transfection, annealed DsiRNAs were mixed with the transfection reagent (Lipofectamine™ RNAiMAX, Invitrogen) in a volume of 50 μl/well and incubated for 20 minutes at room temperature. The HeLa (human) or HEPA1-6 (mouse) cells were trypsinized, resuspended in media, and added to wells (100 uL per well) to give a final DsiRNA concentration of 1 nM in a volume of 150 Each DsiRNA transfection mixture was added to 3 wells for triplicate DsiRNA treatments. Cells were incubated at 37° C. for 24 hours in the continued presence of the DsiRNA transfection mixture. At 24 hours, RNA was prepared from each well of treated cells. The supernatants with the transfection mixtures were first removed and discarded, then the cells were lysed and RNA prepared from each well. Target MET RNA levels following treatment were evaluated by qRT-PCR for the MET target gene, with values normalized to those obtained for controls. Triplicate data was averaged and the % error determined for each treatment. Normalized data were graphed and the reduction of target mRNA by active DsiRNAs in comparison to controls was determined.

MET targeting DsiRNAs examined for MET inhibitory efficacy in a primary phase of testing are indicated in Tables 11 and 12 below. In this example, 432 asymmetric DsiRNAs (tested DsiRNAs possessed a 25/27mer structure) were constructed and tested for MET inhibitory efficacy in human HeLa and mouse HEPA1-6 cells incubated in the presence of such DsiRNAs at a concentration of 1 nM. The 432 asymmetric DsiRNAs tested included DsiRNAs selected from Tables 2 and 4 above, where sequences and structures of these tested asymmetric DsiRNAs are shown (in above Tables 2 and 4, underlined nucleotide residues indicate 2'-O-methyl modified residues, ribonucleotide residues are shown as UPPER CASE, and deoxyribonucleotide residues are shown as lower case).

Assay of the 432 MET targeting DsiRNAs in human HeLa and mouse HEPA1-6 cells at 1 nM revealed the following MET inhibitory efficacies, presented in Tables 11 and 12. MET levels were determined using qPCR assays positioned at indicated locations within the MET transcript (for human HeLa cell experiments, paired qPCR assays were performed and are indicated as "Hs MET 1548-1708" (Yakima Yellow) and "Hs MET 5621-5785" (FAM); for mouse HEPA1-6 cell experiments, paired qPCR assays were performed and are indicated as "Mm MET 230-363" (FAM) and "Mm MET 5969-6087" (Yakima Yellow)).

TABLE 11

MET Inhibitory Efficacy of DsiRNAs Assayed at 1 nM in Human HeLa Cells

| DsiRNA Name (Human MET Target Location, Transcript Variant 1) | Human MET Target Location, Transcript Variant 2 | Mouse MET Target Location | % Remaining MET mRNA ± % Error (Assay: Hs MET 1548-1708) | % Remaining MET mRNA ± % Error (Assay: Hs MET 5621-5785) |
|---|---|---|---|---|
| MET-136 | 136 |  | 67.8 ± 8.6 | 63.7 ± 7.2 |
| MET-137 | 137 |  | 40.6 ± 5.9 | 41.5 ± 2.4 |
| MET-138 | 138 |  | 33 ± 4.1 | 32.4 ± 4.7 |
| MET-140 | 140 |  | 50.5 ± 8.5 | 37.7 ± 10.7 |
| MET-142 | 142 |  | 40 ± 25.4 | 36.4 ± 10.1 |
| MET-143 | 143 |  | 78.8 ± 9.4 | 124.4 ± 8.3 |
| MET-145 | 145 |  | 55.2 ± 14.4 | 65.3 ± 9.3 |
| MET-146 | 146 |  | 59 ± 13 | 66 ± 13 |
| MET-148 | 148 |  | 38.6 ± 5.4 | 39.7 ± 10.8 |
| MET-155 | 155 |  | 41.4 ± 4.9 | 31 ± 8.4 |
| MET-159 | 159 |  | 15.6 ± 13.5 | 12.8 ± 3.6 |
| MET-225 | 225 |  | 21.9 ± 9.3 | 27.2 ± 9 |
| MET-227 | 227 |  | 47.4 ± 8.2 | 39.7 ± 7.2 |
| MET-234 | 234 |  | 22.9 ± 1.1 | 24.9 ± 3.3 |
| MET-245 | 245 |  | 20.3 ± 8.5 | 19.7 ± 8.2 |
| MET-248 | 248 |  | 14 ± 9.5 | 15.3 ± 5.1 |
| MET-249 | 249 |  | 43 ± 5.4 | 35.3 ± 6 |
| MET-409 |  |  | 7.1 ± 28.8 | 4.5 ± 20.3 |
| MET-413 | 413 | m581 | 11 ± 25.1 | 9.2 ± 11.7 |
| MET-414 | 414 | m582 | 26.2 ± 11.9 | 24.1 ± 12.1 |
| MET-415 | 415 | m583 | 17.2 ± 9.4 | 9.8 ± 4 |
| MET-416 | 416 | m584 | 9.4 ± 5.8 | 11.2 ± 6.6 |
| MET-417 | 417 | m585 | 21.6 ± 9.6 | 10.3 ± 7.3 |
| MET-480 | 480 | m648 | 28.8 ± 11.8 | 32.1 ± 9.4 |
| MET-508 | 508 | m676 | 10.8 ± 7.2 | 11.5 ± 7.1 |
| MET-509 | 509 | m677 | 8.5 ± 16.4 | 10 ± 14.9 |
| MET-510 | 510 | m678 | 13.5 ± 7.9 | 10.4 ± 14.3 |
| MET-511 | 511 | m679 | 11.6 ± 12.3 | 10.7 ± 5.5 |
| MET-512 | 512 | m680 | 19.2 ± 8 | 10.9 ± 16 |
| MET-584 | 584 | m752 | 8.3 ± 8.7 | 9.9 ± 4.9 |
| MET-585 | 585 | m753 | 17.2 ± 6.6 | 7.9 ± 10.6 |
| MET-586 | 586 | m754 | 9.8 ± 4.9 | 10.5 ± 2.7 |
| MET-587 | 587 | m755 | 21.8 ± 5.8 | 23.3 ± 3.4 |
| MET-588 | 588 | m756 | 22.6 ± 8.8 | 22.8 ± 5.1 |
| MET-589 | 589 | m757 | 21 ± 7.2 | 17.9 ± 6.7 |
| MET-590 | 590 | m758 | 15.9 ± 11 | 14.7 ± 3.6 |
| MET-591 | 591 | m759 | 17.3 ± 9.8 | 11.6 ± 7.3 |
| MET-592 | 592 | m760 | 34.8 ± 7.2 | 45 ± 9.1 |
| MET-593 | 593 | m761 | 99.2 ± 11.2 | 53.7 ± 11.5 |
| MET-594 | 594 | m762 | 47.9 ± 5.7 | 49.2 ± 4.4 |
| MET-595 | 595 | m763 | 38.6 ± 7.9 | 35.8 ± 2.5 |
| MET-596 | 596 | m764 | 41.3 ± 2.7 | 44.7 ± 4.4 |
| MET-597 | 597 | m765 | 27 ± 18.7 | 25.8 ± 15 |
| MET-881 |  |  | 8.2 ± 7.6 | 6 ± 13.5 |
| MET-967 |  |  | 25.5 ± 12.7 | 14.6 ± 8.1 |
| MET-1009 | 1009 | m1174 | 14.8 ± 6 | 13.7 ± 2.2 |
| MET-1010 | 1010 | m1175 | 30.3 ± 12.3 | 24.3 ± 25.8 |
| MET-1011 | 1011 | m1176 | 16.2 ± 7.3 | 17.2 ± 6.6 |
| MET-1012 | 1012 | m1177 | 19.4 ± 5.4 | 21.1 ± 4 |
| MET-1013 | 1013 | m1178 | 8.1 ± 4.8 | 9.7 ± 3.1 |
| MET-1014 | 1014 | m1179 | 8.3 ± 5.3 | 11.7 ± 3.7 |
| MET-1036 |  |  | 13 ± 15.5 | 16.7 ± 12.9 |
| MET-1038 | 1038 | m1203 | 6.9 ± N/A | 8.9 ± N/A |
| MET-1039 | 1039 | m1204 | 12.5 ± 9.2 | 10.8 ± 6.3 |

TABLE 11-continued

MET Inhibitory Efficacy of DsiRNAs Assayed at 1 nM in Human HeLa Cells

| DsiRNA Name (Human MET Target Location, Transcript Variant 1) | Human MET Target Location, Transcript Variant 2 | Mouse MET Target Location | % Remaining MET mRNA ± % Error (Assay: Hs MET 1548-1708) | % Remaining MET mRNA ± % Error (Assay: Hs MET 5621-5785) |
|---|---|---|---|---|
| MET-1040 | 1040 | m1205 | 8.6 ± 9.4 | 8.2 ± 2.9 |
| MET-1041 | 1041 | m1206 | 12 ± 6.9 | 8.2 ± 7.7 |
| MET-1042 | 1042 | m1207 | 7.3 ± 20.5 | 8.2 ± 12.4 |
| MET-1056 | 1056 | | 22.7 ± 12.6 | 21.3 ± 8.8 |
| MET-1099 | | | 11.8 ± 9.8 | 20.8 ± 5.3 |
| MET-1144 | | | 8.5 ± 10.3 | 8.3 ± 5 |
| MET-1163 | 1163 | | 88.1 ± N/A | 101.6 ± N/A |
| MET-1250 | 1250 | m1415 | 15 ± 9.5 | 16.2 ± 11.3 |
| MET-1251 | 1251 | m1416 | 15.5 ± 12.8 | 16.5 ± 5.1 |
| MET-1252 | 1252 | m1417 | 7.9 ± 10.2 | 10.4 ± 15.1 |
| MET-1253 | 1253 | m1418 | 7.8 ± 5 | 9.4 ± 0.7 |
| MET-1254 | 1254 | m1419 | 11.8 ± 9.1 | 11.1 ± 9.5 |
| MET-1358 | 1358 | m1523 | 8.8 ± 2.6 | 9 ± 2.8 |
| MET-1359 | 1359 | m1524 | 13 ± 4.4 | 9.8 ± 6 |
| MET-1360 | 1360 | m1525 | 6.7 ± 7.3 | 8 ± 2.7 |
| MET-1361 | 1361 | m1526 | 8.1 ± 5.4 | 9.7 ± 8.4 |
| MET-1362 | 1362 | m1527 | 7.3 ± 7.5 | 8.7 ± 8.7 |
| MET-1363 | 1363 | m1528 | 23.2 ± 8.8 | 27 ± 11.4 |
| MET-1364 | 1364 | m1529 | 13.9 ± 10.1 | 16.7 ± 5.9 |
| MET-1365 | 1365 | m1530 | 16.8 ± 14 | 14.5 ± 6.5 |
| MET-1366 | 1366 | m1531 | 22.2 ± 5.5 | 21.7 ± 7.4 |
| MET-1367 | 1367 | m1532 | 45.4 ± 10.8 | 31.8 ± 10.2 |
| MET-1368 | 1368 | m1533 | 37.6 ± 18.2 | 45.4 ± 11.7 |
| MET-1369 | 1369 | m1534 | 16.6 ± 5.8 | 21.4 ± 7.5 |
| MET-1370 | 1370 | m1535 | 22.2 ± 7.6 | 21.1 ± 3.9 |
| MET-1371 | 1371 | m1536 | 12.5 ± N/A | 11.1 ± N/A |
| MET-1469 | 1469 | | 25.8 ± 4.3 | 26.2 ± 8 |
| MET-1471 | 1471 | | 38.9 ± 11.1 | 26.6 ± 5.5 |
| MET-1473 | 1473 | | 12.2 ± 14.4 | 16.2 ± 8.5 |
| MET-1474 | 1474 | | 13.8 ± 7.2 | 11 ± 13.3 |
| MET-1476 | 1476 | | 20.6 ± 21.7 | 26.3 ± 13.6 |
| MET-1478 | 1478 | | 21.7 ± 14.8 | 25.4 ± 4 |
| MET-1479 | 1479 | | 14.8 ± 11.8 | 10.1 ± 8.4 |
| MET-1480 | 1480 | | 37 ± 12.1 | 27 ± 4.5 |
| MET-1481 | 1481 | | 33.9 ± 2.3 | 30 ± 4.1 |
| MET-1953 | 1953 | m2118 | 34.6 ± 13.5 | 37.9 ± 12.3 |
| MET-1954 | 1954 | m2119 | 18 ± 8.3 | 19.6 ± 11.8 |
| MET-1955 | 1955 | m2120 | 15.4 ± 7 | 18.1 ± 5.5 |
| MET-1956 | 1956 | m2121 | 23.5 ± 17.1 | 16.7 ± 10.5 |
| MET-1957 | 1957 | m2122 | 13.6 ± 2.6 | 16.2 ± 3 |
| MET-1958 | 1958 | m2123 | 24.4 ± 8.5 | 31.9 ± 6.4 |
| MET-1959 | 1959 | m2124 | 29 ± 6.8 | 30.6 ± 7.4 |
| MET-1960 | 1960 | m2125 | 24.1 ± 5.4 | 21.4 ± 6.5 |
| MET-1961 | 1961 | m2126 | 9.3 ± 7.7 | 10.7 ± 10.2 |
| MET-1962 | 1962 | m2127 | 14.2 ± 11.5 | 13.9 ± 10.8 |
| MET-1982 | | | 8.7 ± 12 | 8 ± 9.6 |
| MET-1987 | 1987 | m2152 | 6.1 ± 12.4 | 6.7 ± 12.3 |
| MET-1988 | 1988 | m2153 | 7 ± 15.5 | 5.2 ± 4.1 |
| MET-2075 | 2075 | m2240 | 26.4 ± 2.1 | 48.2 ± 3.4 |
| MET-2076 | 2076 | m2241 | 43.2 ± 7.6 | 62.8 ± 7.7 |
| MET-2113 | | | 6.3 ± 7.1 | 6.2 ± 8.7 |
| MET-2290 | | | 9.8 ± 6.6 | 6.8 ± 3.3 |
| MET-2668 | 2614 | | 76.6 ± 3.7 | 73.4 ± 7.2 |
| MET-2790 | 2736 | m2901 | 5.9 ± 2.3 | 7.5 ± 6.4 |
| MET-2856 | 2802 | m2967 | 8.7 ± 18.7 | 5.2 ± 13.8 |
| MET-2857 | 2803 | m2968 | 12.2 ± 5.1 | 11.4 ± 3.2 |
| MET-2858 | 2804 | m2969 | 7.3 ± N/A | 7 ± N/A |
| MET-2859 | 2805 | m2970 | 20 ± 11.8 | 22.1 ± 5.3 |
| MET-2860 | 2806 | m2971 | 20.8 ± 9.4 | 8.9 ± 8.2 |
| MET-2861 | 2807 | m2972 | 11.4 ± 21.5 | 16.4 ± 12.3 |
| MET-2862 | 2808 | m2973 | 13.3 ± 22.7 | 18.4 ± 12.5 |
| MET-2863 | 2809 | m2974 | 15.1 ± 4.9 | 23.3 ± 6.7 |
| MET-2864 | 2810 | m2975 | 7.4 ± 11.7 | 9.3 ± 15 |
| MET-2865 | 2811 | m2976 | 9.1 ± 9.3 | 11.9 ± 8.4 |
| MET-2866 | 2812 | m2977 | 15.6 ± 17.7 | 10.6 ± 6.5 |
| MET-2867 | 2813 | m2978 | 12.3 ± 6 | 9.3 ± 3.8 |
| MET-2868 | 2814 | m2979 | 45.4 ± 17 | 11.4 ± 21.8 |
| MET-2869 | 2815 | m2980 | 20.2 ± 7.3 | 20.9 ± 8.4 |
| MET-2870 | 2816 | m2981 | 20.1 ± 16.2 | 20.5 ± 15.7 |
| MET-2871 | 2817 | m2982 | 38.3 ± 7.6 | 46.4 ± 7.9 |
| MET-2872 | 2818 | m2983 | 31.6 ± 11.1 | 34.2 ± 8.5 |
| MET-2873 | 2819 | m2984 | 14.7 ± 9.9 | 8 ± 11.6 |

TABLE 11-continued

MET Inhibitory Efficacy of DsiRNAs Assayed at 1 nM in Human HeLa Cells

| DsiRNA Name (Human MET Target Location, Transcript Variant 1) | Human MET Target Location, Transcript Variant 2 | Mouse MET Target Location | % Remaining MET mRNA ± % Error (Assay: Hs MET 1548-1708) | % Remaining MET mRNA ± % Error (Assay: Hs MET 5621-5785) |
|---|---|---|---|---|
| MET-2874 | 2820 | m2985 | 22.8 ± 7.5 | 7.9 ± 19 |
| MET-2875 | 2821 | m2986 | 17.1 ± 9.4 | 9 ± 16.3 |
| MET-2876 | 2822 | m2987 | 35.4 ± 11.6 | 11.6 ± 10.8 |
| MET-2877 | 2823 | m2988 | 14.2 ± 10.7 | 10.1 ± 8.2 |
| MET-2878 | 2824 | m2989 | 15.9 ± 14.6 | 11.6 ± 14.7 |
| MET-2879 | 2825 | m2990 | 13.3 ± 4.4 | 8.5 ± 6.5 |
| MET-2880 | 2826 | m2991 | 14.8 ± 10 | 10.4 ± 7 |
| MET-2881 | 2827 | m2992 | 13 ± 5.5 | 7.9 ± 5.8 |
| MET-2882 | 2828 | m2993 | 7.7 ± 6.6 | 4.8 ± 6.6 |
| MET-2883 | 2829 | m2994 | 12.6 ± 4.8 | 9.6 ± 4.8 |
| MET-2884 | 2830 | m2995 | 18.4 ± 13.5 | 9.6 ± 8.4 |
| MET-2973 | 2919 | m3084 | 30.3 ± 15.2 | 35.7 ± 14.5 |
| MET-2974 | 2920 | m3085 | 9.9 ± 1.8 | 21.3 ± 6 |
| MET-2975 | 2921 | m3086 | 10.7 ± 12 | 11.4 ± 14.3 |
| MET-2976 | 2922 | m3087 | 9.9 ± 19.6 | 12 ± 13.4 |
| MET-2977 | 2923 | m3088 | 21.2 ± 9.1 | 22.8 ± 7.6 |
| MET-2978 | 2924 | m3089 | 32.2 ± 6.1 | 29.2 ± 4.7 |
| MET-2979 | 2925 | m3090 | 26.3 ± 7.6 | 27.6 ± 8.2 |
| MET-2980 | 2926 | m3091 | 19 ± 10.8 | 12.2 ± 4.1 |
| MET-2981 | 2927 | m3092 | 11.4 ± 9.6 | 12.3 ± 6.5 |
| MET-2982 | 2928 | m3093 | 11 ± 3 | 19.9 ± 3.9 |
| MET-2983 | 2929 | m3094 | 18.1 ± 7.2 | 18.1 ± 4.3 |
| MET-2984 | 2930 | m3095 | 13.7 ± 6.2 | 16.2 ± 6.4 |
| MET-2985 | 2931 | m3096 | 11.7 ± 4.7 | 10.2 ± 4.6 |
| MET-2986 | 2932 | m3097 | 12.7 ± 8.2 | 8.5 ± 11.8 |
| MET-2987 | 2933 | m3098 | 8.1 ± 11.6 | 4.6 ± 11.8 |
| MET-2988 | 2934 | m3099 | 14.6 ± 1.8 | 9.2 ± 9.2 |
| MET-2989 | 2935 | m3100 | 8.1 ± 3.4 | 10.3 ± 2 |
| MET-3112 | 3058 | | 16.9 ± 9.5 | 8.4 ± 6.5 |
| MET-3126 | | | 10.8 ± 4.7 | 9.2 ± 4.5 |
| MET-3148 | 3094 | m3256 | 14.9 ± 14 | 27.9 ± 12.3 |
| MET-3149 | 3095 | m3257 | 37.2 ± 16.9 | 45.6 ± 14.4 |
| MET-3150 | 3096 | m3258 | 12.1 ± 3.3 | 10.4 ± 4.4 |
| MET-3151 | 3097 | m3259 | 40.4 ± 6.1 | 40.9 ± 3.6 |
| MET-3152 | 3098 | m3260 | 24.2 ± 48.8 | 18.6 ± 48.8 |
| MET-3153 | 3099 | m3261 | 14.3 ± 4.2 | 8.8 ± 4.8 |
| MET-3154 | 3100 | m3262 | 19.9 ± 8.7 | 17.3 ± 9.2 |
| MET-3155 | 3101 | m3263 | 36 ± 7.9 | 33.8 ± 6.7 |
| MET-3156 | 3102 | m3264 | 18.2 ± 6.7 | 20 ± 5.1 |
| MET-3157 | 3103 | m3265 | 12.5 ± 11.3 | 7.4 ± 12.6 |
| MET-3158 | 3104 | m3266 | 8.8 ± 4 | 5.3 ± 4.4 |
| MET-3159 | 3105 | m3267 | 8.4 ± 41.8 | 6.6 ± 31.4 |
| MET-3193 | 3139 | m3301 | 17.7 ± 5.2 | 11.5 ± 4.9 |
| MET-3194 | 3140 | m3302 | 13.1 ± 5.3 | 10.4 ± 6.8 |
| MET-3195 | 3141 | m3303 | 17.7 ± 9.5 | 15.8 ± 11.2 |
| MET-3196 | 3142 | m3304 | 19.6 ± 5.3 | 20.5 ± 2.2 |
| MET-3197 | 3143 | m3305 | 21.7 ± 3.6 | 25 ± 7.4 |
| MET-3198 | 3144 | m3306 | 25.7 ± 3.8 | 18.6 ± 6.4 |
| MET-3199 | 3145 | m3307 | 13.2 ± 12.2 | 7.8 ± 10.4 |
| MET-3200 | 3146 | m3308 | 16.8 ± 6.4 | 14.4 ± 8.9 |
| MET-3201 | 3147 | m3309 | 37.7 ± 10.7 | 29 ± 8.6 |
| MET-3202 | 3148 | m3310 | 22.7 ± 3.4 | 22.8 ± 3 |
| MET-3203 | 3149 | m3311 | 19.7 ± 9.7 | 28.4 ± 3.6 |
| MET-3204 | 3150 | m3312 | 53.2 ± 9.1 | 61.9 ± 7.3 |
| MET-3205 | 3151 | m3313 | 12.6 ± 9.3 | 12.2 ± 13.7 |
| MET-3206 | 3152 | m3314 | 24.3 ± N/A | 42.3 ± N/A |
| MET-3207 | 3153 | m3315 | 28.1 ± 6.4 | 19.7 ± 7.7 |
| MET-3208 | 3154 | m3316 | 14 ± 7.7 | 11.9 ± 6.5 |
| MET-3209 | 3155 | m3317 | 20.7 ± N/A | 14.9 ± N/A |
| MET-3210 | 3156 | m3318 | 10.5 ± 13.3 | 9.9 ± 11.6 |
| MET-3211 | 3157 | m3319 | 9.9 ± 14.2 | 26.7 ± 17.4 |
| MET-3212 | 3158 | m3320 | 10 ± 5 | 7.6 ± 4.5 |
| MET-3213 | 3159 | m3321 | 8 ± 5.9 | 6.2 ± 12.8 |
| MET-3214 | 3160 | m3322 | 11.2 ± 4.6 | 6.9 ± 9.3 |
| MET-3215 | 3161 | m3323 | 12.3 ± N/A | 11 ± N/A |
| MET-3216 | 3162 | m3324 | 35.3 ± N/A | 33 ± N/A |
| MET-3276 | 3222 | m3384 | 13.1 ± 8.4 | 5.9 ± 8.4 |
| MET-3419 | 3365 | m3527 | 10.6 ± 15.9 | 7.2 ± 15.6 |
| MET-3420 | 3366 | m3528 | 10.8 ± 12.7 | 12.1 ± 4.6 |
| MET-3421 | 3367 | m3529 | 19.5 ± 7.9 | 19.4 ± 8.6 |
| MET-3422 | 3368 | m3530 | 15.7 ± 5.3 | 17.9 ± 7.3 |
| MET-3423 | 3369 | m3531 | 18.4 ± 8.7 | 13.3 ± 11.2 |

TABLE 11-continued

MET Inhibitory Efficacy of DsiRNAs Assayed at 1 nM in Human HeLa Cells

| DsiRNA Name (Human MET Target Location, Transcript Variant 1) | Human MET Target Location, Transcript Variant 2 | Mouse MET Target Location | % Remaining MET mRNA ± % Error (Assay: Hs MET 1548-1708) | % Remaining MET mRNA ± % Error (Assay: Hs MET 5621-5785) |
|---|---|---|---|---|
| MET-3424 | 3370 | m3532 | 76.2 ± 3.8 | 65.6 ± 4.2 |
| MET-3425 | 3371 | m3533 | 28.7 ± 5.3 | 24.3 ± 2.7 |
| MET-3426 | 3372 | m3534 | 20.8 ± 7.6 | 15.6 ± 6.1 |
| MET-3427 | 3373 | m3535 | 19.8 ± 4 | 17.3 ± 3.8 |
| MET-3428 | 3374 | m3536 | 13 ± 15.7 | 15 ± 10.2 |
| MET-3429 | 3375 | m3537 | 72.7 ± 2 | 75.9 ± 2.7 |
| MET-3430 | 3376 | m3538 | 54.3 ± 13.6 | 70.2 ± 11.4 |
| MET-3431 | 3377 | m3539 | 40.4 ± 15.6 | 42.7 ± 5.1 |
| MET-3432 | 3378 | m3540 | 22.5 ± 8.1 | 22.4 ± 6.4 |
| MET-3433 | 3379 | m3541 | 70.8 ± 9.4 | 60.1 ± 10.5 |
| MET-3434 | 3380 | m3542 | 0.2 ± 53.3 | 0.2 ± 45.1 |
| MET-3435 | 3381 | m3543 | 49.7 ± 7.5 | 41 ± 8.2 |
| MET-3436 | 3382 | m3544 | 60.8 ± 6.1 | 50.5 ± 11.4 |
| MET-3437 | 3383 | m3545 | 25.3 ± 8.4 | 17.1 ± 6.6 |
| MET-3438 | 3384 | m3546 | 96 ± 5.8 | 83 ± 8.9 |
| MET-3488 | 3434 | m3596 | 9.3 ± 8 | 4.5 ± 9 |
| MET-3489 | 3435 | m3597 | 9.4 ± 9.2 | 5.1 ± 7.9 |
| MET-3490 | 3436 | m3598 | 9.4 ± N/A | 6.8 ± N/A |
| MET-3491 | 3437 | m3599 | 8 ± 28.2 | 4.5 ± 29 |
| MET-3492 | 3438 | m3600 | 9.2 ± 2.8 | 4.8 ± 2.7 |
| MET-3493 | 3439 | m3601 | 10.1 ± 7.9 | 4.8 ± 3.7 |
| MET-3494 | 3440 | m3602 | 10.5 ± 7.7 | 5.9 ± 7.6 |
| MET-3495 | 3441 | m3603 | 20.8 ± 8.3 | 12.4 ± 10.6 |
| MET-3496 | 3442 | m3604 | 9.3 ± 2.9 | 6.4 ± 2.1 |
| MET-3497 | 3443 | m3605 | 10 ± 15.7 | 7.1 ± 12.2 |
| MET-3498 | 3444 | m3606 | 8.4 ± 6.5 | 5.7 ± 5.5 |
| MET-3499 | 3445 | m3607 | 11.5 ± 12.3 | 6.1 ± 19.8 |
| MET-3500 | 3446 | m3608 | 20.7 ± 8.8 | 17.1 ± 5.5 |
| MET-3501 | 3447 | m3609 | 27.5 ± 8.5 | 21.3 ± 8.8 |
| MET-3502 | 3448 | m3610 | 38.5 ± 12.4 | 34.1 ± 11.2 |
| MET-3503 | 3449 | m3611 | 57.7 ± 16 | 50.8 ± 13.6 |
| MET-3504 | 3450 | m3612 | 13.7 ± 9.6 | 11.7 ± 10 |
| MET-3505 | 3451 | m3613 | 17.3 ± 6.2 | 17.4 ± 1.6 |
| MET-3506 | 3452 | m3614 | 10.2 ± 9.1 | 8.8 ± 5.1 |
| MET-3507 | 3453 | m3615 | 20.8 ± N/A | 15.1 ± N/A |
| MET-3508 | 3454 | m3616 | 23.2 ± 8.9 | 14.9 ± 5.4 |
| MET-3509 | 3455 | m3617 | 11.2 ± 10.9 | 19.3 ± 14.2 |
| MET-3510 | 3456 | m3618 | 23.9 ± 23.6 | 17.1 ± 18.5 |
| MET-3511 | 3457 | m3619 | 11.2 ± 9.4 | 9.8 ± 9.3 |
| MET-3512 | 3458 | m3620 | 13 ± 5 | 8.1 ± 7.8 |
| MET-3513 | 3459 | m3621 | 23 ± 20.2 | 15.6 ± 16.8 |
| MET-3514 | 3460 | m3622 | 23.2 ± 6.2 | 13.7 ± 3.8 |
| MET-3515 | 3461 | m3623 | 27.3 ± 11.5 | 13.6 ± 7.4 |
| MET-3572 | 3518 | m3680 | 18.5 ± 7.2 | 10.2 ± 9 |
| MET-3573 | 3519 | m3681 | 14.6 ± 6.9 | 24.9 ± 6.4 |
| MET-3574 | 3520 | m3682 | 12.4 ± 1.9 | 7.2 ± 5.3 |
| MET-3575 | 3521 | m3683 | 9.9 ± 5.2 | 8.7 ± 4.6 |
| MET-3576 | 3522 | m3684 | 10.6 ± 2 | 5.3 ± 4.7 |
| MET-3577 | 3523 | m3685 | 14.7 ± 5.4 | 9.2 ± 4.9 |
| MET-3578 | 3524 | m3686 | 10.7 ± 6.6 | 5.3 ± 6.8 |
| MET-3579 | 3525 | m3687 | 12.9 ± 14.3 | 4.8 ± 18 |
| MET-3580 | 3526 | m3688 | 12.1 ± 6.5 | 5.8 ± 6.3 |
| MET-3581 | 3527 | m3689 | 8.2 ± 5.3 | 6.6 ± 18.6 |
| MET-3582 | 3528 | m3690 | 9.5 ± 10 | 4.8 ± 3.3 |
| MET-3644 | 3590 | m3752 | 7.9 ± 6.4 | 4.5 ± 13.1 |
| MET-3645 | 3591 | m3753 | 14.6 ± 6.6 | 8.5 ± 6.5 |
| MET-3779 | 3725 | m3887 | 12.8 ± 11.8 | 6.9 ± 18.1 |
| MET-3780 | 3726 | m3888 | 11.4 ± 7 | 4.9 ± 7.9 |
| MET-3795 | 3741 |  | 36.3 ± 7.7 | 34.6 ± 6.6 |
| MET-3812 | 3758 |  | 32.3 ± 5.2 | 23.4 ± 5.8 |
| MET-3821 | 3767 | m3929 | 9.5 ± 21.4 | 5.9 ± 20.9 |
| MET-3822 | 3768 | m3930 | 10.4 ± 4.2 | 4.4 ± 6.1 |
| MET-3823 | 3769 | m3931 | 8.1 ± 12.3 | 7.2 ± 11.5 |
| MET-3824 | 3770 | m3932 | 11.7 ± 6.6 | 6.3 ± 9.2 |
| MET-3825 | 3771 | m3933 | 8.3 ± 5.5 | 5 ± 1.3 |
| MET-3826 | 3772 | m3934 | 8.7 ± 0.9 | 4.1 ± 1.7 |
| MET-3827 | 3773 | m3935 | 6.6 ± 29.2 | 3.6 ± 23.5 |
| MET-3828 | 3774 | m3936 | 22.8 ± 10.5 | 17.4 ± 3.8 |
| MET-3829 | 3775 | m3937 | 22.7 ± 5.9 | 17.2 ± 4.6 |
| MET-3830 | 3776 | m3938 | 11.8 ± 8.1 | 7.3 ± 9 |
| MET-3831 | 3777 | m3939 | 9.7 ± 12.2 | 8 ± 10.3 |
| MET-3832 | 3778 | m3940 | 15.7 ± 5.2 | 13.2 ± 1.8 |

TABLE 11-continued

MET Inhibitory Efficacy of DsiRNAs Assayed at 1 nM in Human HeLa Cells

| DsiRNA Name (Human MET Target Location, Transcript Variant 1) | Human MET Target Location, Transcript Variant 2 | Mouse MET Target Location | % Remaining MET mRNA ± % Error (Assay: Hs MET 1548-1708) | % Remaining MET mRNA ± % Error (Assay: Hs MET 5621-5785) |
|---|---|---|---|---|
| MET-3833 | 3779 | m3941 | 19.1 ± 7 | 16.2 ± 6.2 |
| MET-3834 | 3780 | m3942 | 9 ± 5.5 | 6.7 ± 6.8 |
| MET-3854 | 3800 | m3962 | 10.3 ± 6.5 | 9.6 ± 5.9 |
| MET-3855 | 3801 | m3963 | 12.1 ± 9.5 | 8.2 ± 12.3 |
| MET-3856 | 3802 | m3964 | 15.5 ± 12.5 | 10.2 ± 9.3 |
| MET-3857 | 3803 | m3965 | 11.5 ± 8 | 7.7 ± 7.6 |
| MET-3858 | 3804 | m3966 | 13.4 ± 9.8 | 13.8 ± 9.8 |
| MET-3859 | 3805 | m3967 | 12.8 ± 6.4 | 11.5 ± 3.9 |
| MET-3860 | 3806 | m3968 | 16.4 ± 7.3 | 13.6 ± 3.4 |
| MET-3861 | 3807 | m3969 | 27.3 ± 7.8 | 26.4 ± 9.1 |
| MET-3877 | 3823 | | 16.9 ± 10.2 | 12.6 ± 7.4 |
| MET-3879 | 3825 | | 14.2 ± 4.8 | 9.8 ± 9.2 |
| MET-3880 | 3826 | | 17.6 ± 4.1 | 15.8 ± 8.9 |
| MET-3881 | 3827 | | 26.8 ± 7 | 23.3 ± 5.5 |
| MET-3882 | 3828 | | 16.7 ± 4.4 | 12.5 ± 7.6 |
| MET-3917 | 3863 | | 11.9 ± 5.9 | 8.4 ± 11 |
| MET-3922 | 3868 | | 11.2 ± 6.8 | 5.4 ± 5.8 |
| MET-3924 | 3870 | | 36 ± 8.8 | 17.9 ± 8.6 |
| MET-3935 | 3881 | m4043 | 10.1 ± 3.9 | 6.4 ± 5.8 |
| MET-3936 | 3882 | m4044 | 9.3 ± 13.3 | 5.3 ± 8.3 |
| MET-3997 | 3943 | | 52.9 ± 8 | 59.9 ± 7 |
| MET-3998 | 3944 | | 49.8 ± 7 | 48.8 ± 3.3 |
| MET-4009 | 3955 | | 20.5 ± 6.9 | 16.5 ± 5 |
| MET-4011 | 3957 | | 14.9 ± 8.1 | 6.5 ± 5.5 |
| MET-4018 | 3964 | | 19.3 ± 9.1 | 7.8 ± 5.6 |
| MET-4069 | 4015 | | 97.4 ± 4.1 | 110.7 ± 10.5 |
| MET-4071 | 4017 | | 173.8 ± 12.1 | 111.6 ± 5.7 |
| MET-4072 | 4018 | | 121.6 ± N/A | 135.5 ± N/A |
| MET-4073 | 4019 | | 22 ± 32.3 | 19.9 ± 29.3 |
| MET-4074 | 4020 | | 67 ± 5.2 | 79 ± 1.3 |
| MET-4319 | 4265 | m4427 | 6.6 ± 27.6 | 4.6 ± 12.8 |
| MET-4320 | 4266 | m4428 | 9.5 ± 15.6 | 3.5 ± 10.9 |
| MET-4367 | 4313 | | 12.8 ± 7.2 | 12.1 ± 6.3 |
| MET-4523 | 4469 | | 19.4 ± 10.9 | 6.2 ± 8.8 |
| MET-4559 | | | 10.6 ± 16.2 | 4.7 ± 13.2 |
| MET-4575 | 4521 | m4710 | 16.7 ± 7.9 | 5.1 ± 9.2 |
| MET-4576 | 4522 | m4711 | 17.2 ± 6.4 | 8.2 ± 4.3 |
| MET-4703 | | | 6 ± 6.7 | 8 ± 1.2 |
| MET-4935 | 4881 | m5054 | 15.6 ± 8.3 | 8.8 ± 6.1 |
| MET-4947 | | | 6.3 ± 12.5† | 10.2 ± 10.4† |
| MET-4974 | 4920 | | 22.8 ± N/A | 16.9 ± N/A |
| MET-4976 | 4922 | | 32.5 ± 14.2 | 28.6 ± 10.2 |
| MET-4980 | 4926 | | 39.5 ± 9 | 26.6 ± 13.2 |
| MET-4982 | 4928 | | 46.7 ± 4.7 | 33.8 ± 6.4 |
| MET-4986 | 4932 | | 51.7 ± 6.1 | 36.9 ± 5.6 |
| MET-4996 | 4942 | | 42 ± 7.6 | 39.1 ± 8.8 |
| MET-5003 | 4949 | | 37.5 ± 6.9 | 29.1 ± 4 |
| MET-5094 | | | 5.6 ± 8.2 | 4 ± 6.7 |
| MET-5234 | | | 6.9 ± 7.6 | 6 ± 6.5 |
| MET-5265 | | | 6 ± 4.9 | 4.9 ± 8.1 |
| MET-5313 | | | 12.7 ± 14.1 | 11.4 ± 5.7 |
| MET-5357 | | | 5.2 ± 4.9 | 4.7 ± 8.3 |
| MET-5479 | | | 19.8 ± 6 | 12.4 ± 6.5 |
| MET-5548 | 5494 | | 21.4 ± 3.8 | 8.7 ± 3.7 |
| MET-5634 | 5580 | | 20.8 ± 7.4 | 7.1 ± 6.9 |
| MET-5847 | 5793 | m5824 | 15.4 ± 16.9 | 6.3 ± 15 |
| MET-5848 | 5794 | | 12.6 ± 12.8 | 6.9 ± 12.5 |
| MET-5850 | 5796 | | 29.8 ± 13.8 | 6.5 ± 8.5 |
| MET-5853 | 5799 | | 26.9 ± 9.5 | 20.4 ± 17.5 |
| MET-5856 | 5802 | | 94.7 ± 11.4 | 52 ± 9.5 |
| MET-5858 | 5804 | | 57.1 ± 11.8 | 45.5 ± 14.6 |
| MET-5859 | 5805 | | 50.1 ± 11.9 | 46.8 ± 7 |
| MET-5860 | 5806 | | 33.2 ± 0.5 | 16 ± 14.1 |
| MET-5861 | 5807 | | 30.1 ± 8.4 | 13.7 ± 12.6 |
| MET-5862 | 5808 | | 28.4 ± 3.8 | 12 ± 13.1 |
| MET-5864 | 5810 | | 24.7 ± 15.3 | 17.4 ± 11.7 |
| MET-5866 | 5812 | | 28.1 ± 8 | 8.6 ± 14.3 |
| MET-5867 | 5813 | m5844 | 24.7 ± 8.9 | 20.6 ± 5.2 |
| MET-5868 | 5814 | m5845 | 15.2 ± N/A | 13.5 ± N/A |
| MET-5919 | | | 4.5 ± 3.5 | 4.9 ± 3.5 |
| MET-5946 | | | 4 ± 5.7 | 6.2 ± 9.2 |
| MET-5947 | 5893 | m5923 | 26.2 ± 6 | 13.7 ± 2.7 |

TABLE 11-continued

MET Inhibitory Efficacy of DsiRNAs Assayed at 1 nM in Human HeLa Cells

| DsiRNA Name (Human MET Target Location, Transcript Variant 1) | Human MET Target Location, Transcript Variant 2 | Mouse MET Target Location | % Remaining MET mRNA ± % Error (Assay: Hs MET 1548-1708) | % Remaining MET mRNA ± % Error (Assay: Hs MET 5621-5785) |
|---|---|---|---|---|
| MET-5948 | 5894 | m5924 | 16.2 ± 7.6 | 4.7 ± 7.7 |
| MET-6002 | | | 6.7 ± 15.8 | 5.5 ± 7.7 |
| MET-6075 | 6021 | m6054 | 17.1 ± 8.8 | 4.8 ± 13.8 |
| MET-6076 | 6022 | m6055 | 12.4 ± 8.6 | 5.9 ± 12.4 |
| MET-6077 | 6023 | m6056 | 14.4 ± 4.6 | 7.6 ± 6.4 |
| MET-6078 | 6024 | m6057 | 13.8 ± 5.1 | 4.8 ± 6.2 |
| MET-6079 | 6025 | m6058 | 10.1 ± 10.5 | 4.4 ± 12.2 |
| MET-6080 | 6026 | m6059 | 13.6 ± 5.2 | 5.8 ± 9.3 |
| MET-6124 | 6070 | m6103 | 18.3 ± 13.9 | 8.7 ± 11.3 |
| MET-6125 | 6071 | m6104 | 11.9 ± 6.3 | 6.2 ± 6.7 |
| MET-6126 | 6072 | m6105 | 17.4 ± 9 | 8.2 ± 8.1 |
| MET-6127 | 6073 | m6106 | 10.3 ± 4.3 | 6.3 ± 5.5 |
| MET-6128 | 6074 | m6107 | 13.8 ± 5.1 | 9.6 ± 5.9 |
| MET-6307 | | | 7.2 ± 11.9 | 6.1 ± 10.3 |
| MET-6520 | | | 7.9 ± 6.1 | 7.1 ± 5.4 |
| MET-6599 | 6545 | m6567 | 13.3 ± 6.8 | 7 ± 6.1 |
| MET-6600 | 6546 | m6568 | 14.2 ± 4.5 | 5.9 ± 5 |
| MET-6601 | 6547 | m6569 | 14.5 ± 6.6 | 5.9 ± 3.4 |

†Normalized against Hs SFRS9 only

TABLE 12

MET Inhibitory Efficacy of DsiRNAs Assayed at 1 nM in Mouse HEPA1-6 Cells

| DsiRNA Name (Human MET Target Location, Transcript Variant 1) | Human MET Target Location, Transcript Variant 2 | Mouse MET Target Location/DsiRNA Name | % Remaining MET mRNA ± % Error (Assay: Mm MET 230-363) | % Remaining MET mRNA ± % Error (Assay: Mm MET 5969-6087) |
|---|---|---|---|---|
| MET-413 | 413 | m581 | 82.9 ± 4.8 | 89.5 ± 10.7 |
| MET-414 | 414 | m582 | 66.7 ± 12.3 | 70.6 ± 2.2 |
| MET-415 | 415 | m583 | 69.2 ± 2.3 | 62.7 ± 1.3 |
| MET-416 | 416 | m584 | 28.4 ± 24.5 | 32.3 ± 12.7 |
| MET-417 | 417 | m585 | 88.5 ± 13 | 61.3 ± 3.7 |
| MET-480 | 480 | m648 | 30.3 ± 7.4 | 25.8 ± 9.2 |
| MET-508 | 508 | m676 | 29.2 ± 8.4 | 28.7 ± 3.1 |
| MET-509 | 509 | m677 | 26.7 ± N/A | 30.5 ± N/A |
| MET-510 | 510 | m678 | 24.7 ± 7.6 | 21.8 ± 7 |
| MET-511 | 511 | m679 | 21.2 ± 8.8 | 20.1 ± 4.3 |
| MET-512 | 512 | m680 | 27.9 ± 2.6 | 23.6 ± 2.2 |
| MET-584 | 584 | m752 | 19.2 ± 6.6 | 17.6 ± 2.2 |
| MET-585 | 585 | m753 | 26.9 ± 5.4 | 18.3 ± 5 |
| MET-586 | 586 | m754 | 17.5 ± 6.5 | 14.9 ± 2.5 |
| MET-587 | 587 | m755 | 43.3 ± 3.4 | 38.4 ± 1.4 |
| MET-588 | 588 | m756 | 40.4 ± 1.1 | 43.1 ± 3.4 |
| MET-589 | 589 | m757 | 25.3 ± N/A | 24.3 ± N/A |
| MET-590 | 590 | m758 | 18.2 ± 5.5 | 19.8 ± 4.2 |
| MET-591 | 591 | m759 | 20.4 ± 7.2 | 20.2 ± 6.4 |
| MET-592 | 592 | m760 | 48.8 ± 5.8 | 56.4 ± 2.3 |
| MET-593 | 593 | m761 | 65.2 ± 5.4 | 49.9 ± 5.9 |
| MET-594 | 594 | m762 | 27.3 ± 4 | 31.1 ± 3.6 |
| MET-595 | 595 | m763 | 31.7 ± 6 | 28.9 ± 3.5 |
| MET-596 | 596 | m764 | 43.4 ± 10.3 | 45.9 ± 1.9 |
| MET-597 | 597 | m765 | 100.9 ± 6.6 | 84.7 ± 13.7 |
| MET-1009 | 1009 | m1174 | 48.4 ± 15.1 | 24.9 ± 18.6 |
| MET-1010 | 1010 | m1175 | 46 ± 10.5 | 24.4 ± 12.5 |
| MET-1011 | 1011 | m1176 | 41.2 ± 24.1 | 20.7 ± 16.5 |
| MET-1012 | 1012 | m1177 | 51.7 ± 18.6 | 25.4 ± 14.7 |
| MET-1013 | 1013 | m1178 | 37.3 ± 17 | 20.5 ± 13.3 |
| MET-1014 | 1014 | m1179 | 36.4 ± 11.6 | 21.3 ± 12.8 |
| MET-1038 | 1038 | m1203 | 62.7 ± 1.9 | 35.9 ± 4.2 |
| MET-1039 | 1039 | m1204 | 28.6 ± 6.2 | 13.7 ± 9.7 |
| MET-1040 | 1040 | m1205 | 29.4 ± 4.9 | 16.1 ± 4.5 |
| MET-1041 | 1041 | m1206 | 35.9 ± 5.1 | 23.6 ± 2.3 |
| MET-1042 | 1042 | m1207 | 27.6 ± 7.1 | 15.5 ± 2.3 |
| MET-1250 | 1250 | m1415 | 49.6 ± 2.5 | 25.8 ± 3.5 |
| MET-1251 | 1251 | m1416 | 50.4 ± 3.1 | 31.8 ± 4.6 |
| MET-1252 | 1252 | m1417 | 97.6 ± 2.2 | 59.9 ± 2.3 |

TABLE 12-continued

MET Inhibitory Efficacy of DsiRNAs Assayed at 1 nM in Mouse HEPA1-6 Cells

| DsiRNA Name (Human MET Target Location, Transcript Variant 1) | Human MET Target Location, Transcript Variant 2 | Mouse MET Target Location/DsiRNA Name | % Remaining MET mRNA ± % Error (Assay: Mm MET 230-363) | % Remaining MET mRNA ± % Error (Assay: Mm MET 5969-6087) |
| --- | --- | --- | --- | --- |
| MET-1253 | 1253 | m1418 | 106.1 ± 6.9 | 65.9 ± 7.3 |
| MET-1254 | 1254 | m1419 | 98.2 ± 7.6 | 73.9 ± 4.5 |
| MET-1358 | 1358 | m1523 | 20.7 ± 5.3 | 11.8 ± 5 |
| MET-1359 | 1359 | m1524 | 19.4 ± 1.3 | 11.7 ± 7.7 |
| MET-1360 | 1360 | m1525 | 16.7 ± 2.1 | 9.7 ± 2.8 |
| MET-1361 | 1361 | m1526 | 21.4 ± 1.9 | 11 ± 4.2 |
| MET-1362 | 1362 | m1527 | 21.2 ± 7 | 13.2 ± 5.3 |
| MET-1363 | 1363 | m1528 | 54.3 ± 3.8 | 34.5 ± 2.6 |
| MET-1364 | 1364 | m1529 | 42.5 ± 1.2 | 26.8 ± 5.8 |
| MET-1365 | 1365 | m1530 | 36.9 ± 4.2 | 32.8 ± 9.7 |
| MET-1366 | 1366 | m1531 | 41.7 ± 18.1 | 32.8 ± 17.2 |
| MET-1367 | 1367 | m1532 | 76.9 ± 5.1 | 54.7 ± 7.4 |
| MET-1368 | 1368 | m1533 | 63.9 ± 9 | 44.8 ± 8 |
| MET-1369 | 1369 | m1534 | 40.1 ± 13.9 | 31.3 ± 7 |
| MET-1370 | 1370 | m1535 | 32 ± 8.4 | 26.1 ± 5.9 |
| MET-1371 | 1371 | m1536 | 31.2 ± 4.6 | 21.8 ± 3.2 |
| MET-1953 | 1953 | m2118 | 153.1 ± 5.3 | 143.8 ± 12.2 |
| MET-1954 | 1954 | m2119 | 61.1 ± 9.8 | 48.6 ± 9.2 |
| MET-1955 | 1955 | m2120 | 45.8 ± 4 | 36.6 ± 2.5 |
| MET-1956 | 1956 | m2121 | 46.6 ± 7.5 | 34.2 ± 8.7 |
| MET-1957 | 1957 | m2122 | 35.6 ± 17.1 | 30.7 ± 1.7 |
| MET-1958 | 1958 | m2123 | 68.2 ± 7.9 | 45.7 ± 5.6 |
| MET-1959 | 1959 | m2124 | 49.4 ± 8 | 40.7 ± 6.4 |
| MET-1960 | 1960 | m2125 | 76.2 ± 6.1 | 61.2 ± 6.8 |
| MET-1961 | 1961 | m2126 | 51 ± 6.6 | 39.7 ± 4.1 |
| MET-1962 | 1962 | m2127 | 74.3 ± 5.8 | 63.2 ± 7.2 |
| MET-1987 | 1987 | m2152 | 69.5 ± 9.4 | 62.4 ± 7.3 |
| MET-1988 | 1988 | m2153 | 57.4 ± 7.1 | 47.3 ± 10.9 |
| MET-2075 | 2075 | m2240 | 67.9 ± 5.3 | 53 ± 3.5 |
| MET-2076 | 2076 | m2241 | 38.5 ± 3.9 | 25.8 ± 4.4 |
| MET-2736 | 2736 | m2901 | 27.8 ± 3.2 | 22.9 ± 7.6 |
| MET-2802 | 2802 | m2967 | 25.4 ± 7.6 | 15.6 ± 8.1 |
| MET-2803 | 2803 | m2968 | 36.6 ± 9.5 | 26.7 ± 11.9 |
| MET-2804 | 2804 | m2969 | 28.6 ± 26.2 | 18.5 ± 11.1 |
| MET-2805 | 2805 | m2970 | 32.3 ± 8 | 13.5 ± 10.8 |
| MET-2806 | 2806 | m2971 | 54 ± 11.5 | 22.4 ± 14.1 |
| MET-2807 | 2807 | m2972 | 44.9 ± 16.4 | 21.2 ± 10.7 |
| MET-2808 | 2808 | m2973 | 38.1 ± 15.5 | 31.8 ± 12.3 |
| MET-2809 | 2809 | m2974 | 30.4 ± 10.2 | 16.9 ± 8 |
| MET-2810 | 2810 | m2975 | 33.3 ± 9.7 | 15.9 ± 4.5 |
| MET-2811 | 2811 | m2976 | 35.3 ± 3.2 | 18 ± 3.1 |
| MET-2812 | 2812 | m2977 | 27.1 ± 4.2 | 15.6 ± 6.2 |
| MET-2813 | 2813 | m2978 | 28.9 ± 4.2 | 16.3 ± 2.7 |
| MET-2814 | 2814 | m2979 | 23.8 ± 6.6 | 8.5 ± 5.8 |
| MET-2815 | 2815 | m2980 | 17 ± 2.9 | 9.5 ± 5 |
| MET-2816 | 2816 | m2981 | 18.5 ± 3 | 13.5 ± 2.4 |
| MET-2817 | 2817 | m2982 | 19.9 ± 2 | 8.3 ± 2.8 |
| MET-2818 | 2818 | m2983 | 23.7 ± 4.5 | 10.8 ± 5.7 |
| MET-2819 | 2819 | m2984 | 23.2 ± 3.4 | 10.3 ± 4 |
| MET-2820 | 2820 | m2985 | 24.2 ± 3.5 | 16.1 ± 2.5 |
| MET-2821 | 2821 | m2986 | 23.2 ± 8.9 | 13.5 ± 6.6 |
| MET-2822 | 2822 | m2987 | 29.9 ± 13.2 | 15 ± 2.2 |
| MET-2823 | 2823 | m2988 | 16.7 ± 3.7 | 8.3 ± 5.8 |
| MET-2824 | 2824 | m2989 | 16.4 ± 12.3 | 10.3 ± 3.8 |
| MET-2825 | 2825 | m2990 | 13.2 ± 2.2 | 7.9 ± 3.6 |
| MET-2826 | 2826 | m2991 | 18.2 ± 3 | 9.8 ± 8 |
| MET-2827 | 2827 | m2992 | 25.5 ± 2.6 | 14.5 ± 4.7 |
| MET-2828 | 2828 | m2993 | 33.7 ± 7.5 | 15.5 ± 20.7 |
| MET-2829 | 2829 | m2994 | 37.3 ± 6.3 | 19 ± 16.4 |
| MET-2830 | 2830 | m2995 | 32 ± 9.3 | 16.8 ± 16.6 |
| MET-2919 | 2919 | m3084 | 66.4 ± 12.5 | 42.9 ± 12.9 |
| MET-2920 | 2920 | m3085 | 62.9 ± 12.8 | 41.7 ± 8.7 |
| MET-2921 | 2921 | m3086 | 48 ± 13.1 | 28.4 ± 11.2 |
| MET-2922 | 2922 | m3087 | 60.3 ± 12.7 | 45.8 ± 10.6 |
| MET-2923 | 2923 | m3088 | 99.6 ± N/A | 72.2 ± N/A |
| MET-2924 | 2924 | m3089 | 86 ± 3.4 | 64.7 ± 3 |
| MET-2925 | 2925 | m3090 | 72.8 ± 2.3 | 53.2 ± 3.4 |
| MET-2926 | 2926 | m3091 | 44.3 ± 9.1 | 28 ± 7.9 |
| MET-2927 | 2927 | m3092 | 35.8 ± 8.1 | 26.8 ± 8 |
| MET-2928 | 2928 | m3093 | 48.2 ± 4.4 | 32.1 ± 2.2 |
| MET-2929 | 2929 | m3094 | 67.9 ± 5 | 44.8 ± 4.3 |
| MET-2930 | 2930 | m3095 | 59.6 ± 4.3 | 49.7 ± 7.1 |

TABLE 12-continued

MET Inhibitory Efficacy of DsiRNAs Assayed at 1 nM in Mouse HEPA1-6 Cells

| DsiRNA Name (Human MET Target Location, Transcript Variant 1) | Human MET Target Location, Transcript Variant 2 | Mouse MET Target Location/DsiRNA Name | % Remaining MET mRNA ± % Error (Assay: Mm MET 230-363) | % Remaining MET mRNA ± % Error (Assay: Mm MET 5969-6087) |
|---|---|---|---|---|
| MET-2931 | 2931 | m3096 | 74.5 ± 8.1 | 49.3 ± 4.4 |
| MET-2932 | 2932 | m3097 | 51.2 ± 3.8 | 38.2 ± 1.2 |
| MET-2933 | 2933 | m3098 | 50.4 ± 6 | 39.6 ± 2.4 |
| MET-2934 | 2934 | m3099 | 57.9 ± 7.3 | 52 ± 4 |
| MET-2935 | 2935 | m3100 | 51.2 ± 6.7 | 40.5 ± 3.8 |
| MET-3094 | 3094 | m3256 | 46.1 ± 15.4 | 34.9 ± 8.2 |
| MET-3095 | 3095 | m3257 | 55.6 ± 11.7 | 47.9 ± 4.8 |
| MET-3096 | 3096 | m3258 | 35 ± 4.7 | 17.3 ± 3.4 |
| MET-3097 | 3097 | m3259 | 67.2 ± 4.2 | 46.2 ± 3.5 |
| MET-3098 | 3098 | m3260 | 100.1 ± N/A | 71.9 ± N/A |
| MET-3099 | 3099 | m3261 | 65.5 ± 9.9 | 41.5 ± 12.1 |
| MET-3100 | 3100 | m3262 | 74.8 ± 8.4 | 46.7 ± 11.1 |
| MET-3101 | 3101 | m3263 | 67.2 ± 14 | 41.7 ± 11.4 |
| MET-3102 | 3102 | m3264 | 65.5 ± 9 | 55.3 ± 15.7 |
| MET-3103 | 3103 | m3265 | 49.5 ± 6.4 | 29.3 ± 15.4 |
| MET-3104 | 3104 | m3266 | 38.6 ± 4.8 | 25 ± 10.9 |
| MET-3105 | 3105 | m3267 | 78.6 ± N/A | 94.6 ± N/A |
| MET-3139 | 3139 | m3301 | 69 ± 9.2 | 41.8 ± 7.4 |
| MET-3140 | 3140 | m3302 | 54.2 ± 11.7 | 34.4 ± 2 |
| MET-3141 | 3141 | m3303 | 46 ± 9.3 | 26.9 ± 11.5 |
| MET-3142 | 3142 | m3304 | 58.5 ± 4.7 | 37.5 ± 7.2 |
| MET-3143 | 3143 | m3305 | 53.9 ± 1.8 | 45.3 ± 2.1 |
| MET-3144 | 3144 | m3306 | 59.1 ± 9.7 | 40.1 ± 6.5 |
| MET-3145 | 3145 | m3307 | 46.9 ± 2.7 | 24.5 ± 3.6 |
| MET-3146 | 3146 | m3308 | 51.4 ± 2.2 | 40.2 ± 1.3 |
| MET-3147 | 3147 | m3309 | 73.3 ± 17.6 | 54.9 ± 6.2 |
| MET-3148 | 3148 | m3310 | 61.7 ± 3 | 54.5 ± 3.9 |
| MET-3149 | 3149 | m3311 | 63.8 ± 18.1 | 61.8 ± 7.1 |
| MET-3150 | 3150 | m3312 | 72.1 ± 14.2 | 69.9 ± 2.9 |
| MET-3151 | 3151 | m3313 | 39.5 ± 5.1 | 37.4 ± 5.1 |
| MET-3152 | 3152 | m3314 | 51.2 ± 15.2 | 72.3 ± 8.4 |
| MET-3153 | 3153 | m3315 | 63.8 ± 8.7 | 57.1 ± 2.6 |
| MET-3154 | 3154 | m3316 | 47.5 ± 3.4 | 37.1 ± 3.2 |
| MET-3155 | 3155 | m3317 | 49 ± 8.4* | 56.7 ± 9.2* |
| MET-3156 | 3156 | m3318 | 47.2 ± 3.1* | 45.5 ± 4.4* |
| MET-3157 | 3157 | m3319 | 49.6 ± 2.2* | 53.8 ± 3.5* |
| MET-3158 | 3158 | m3320 | 45.1 ± 6.2* | 44.2 ± 5.4* |
| MET-3159 | 3159 | m3321 | 37.5 ± 4.7* | 36.9 ± 5.4* |
| MET-3160 | 3160 | m3322 | 36.4 ± 3.7* | 34.5 ± 1.9* |
| MET-3161 | 3161 | m3323 | 44.5 ± 5* | 49.9 ± 4.2* |
| MET-3162 | 3162 | m3324 | 85.8 ± 6.5* | 87.8 ± 3.8* |
| MET-3222 | 3222 | m3384 | 36.8 ± N/A* | 30.3 ± N/A* |
| MET-3365 | 3365 | m3527 | 31.8 ± 2.7* | 27.1 ± 2* |
| MET-3366 | 3366 | m3528 | 40.3 ± 4.2* | 29.8 ± 3.5* |
| MET-3367 | 3367 | m3529 | 44.6 ± 3.3* | 43.2 ± 1.5* |
| MET-3368 | 3368 | m3530 | 45.5 ± 3.6* | 41.7 ± 4.3* |
| MET-3369 | 3369 | m3531 | 37.4 ± 3.7* | 35.1 ± 6.4* |
| MET-3370 | 3370 | m3532 | 58.4 ± 7.8* | 60.6 ± 6.5* |
| MET-3371 | 3371 | m3533 | 50.8 ± 3.3* | 44.7 ± 2.3* |
| MET-3372 | 3372 | m3534 | 30.4 ± 6.7* | 27.7 ± 12.9* |
| MET-3373 | 3373 | m3535 | 35.1 ± 5.3* | 30.9 ± 3.3* |
| MET-3374 | 3374 | m3536 | 34.2 ± 8.1* | 29.4 ± 2.1* |
| MET-3375 | 3375 | m3537 | 75.6 ± 5.9* | 69.2 ± 2.6* |
| MET-3376 | 3376 | m3538 | 77.8 ± 12* | 79.1 ± 7* |
| MET-3377 | 3377 | m3539 | 75.8 ± 7.2* | 80.7 ± 4.3* |
| MET-3378 | 3378 | m3540 | 72.7 ± 1.4* | 71.3 ± 2.2* |
| MET-3379 | 3379 | m3541 | 81.3 ± 2.1* | 78.3 ± 4.7* |
| MET-3380 | 3380 | m3542 | 20.4 ± 7.8* | 64.4 ± 8.6* |
| MET-3381 | 3381 | m3543 | 49.4 ± 8.3* | 112.3 ± 13.1* |
| MET-3382 | 3382 | m3544 | 35.8 ± 4* | 87.1 ± 3.6* |
| MET-3383 | 3383 | m3545 | 77.6 ± 1.8* | 76.2 ± 1.7* |
| MET-3384 | 3384 | m3546 | 127.1 ± 10.7* | 98.7 ± 4.6* |
| MET-3434 | 3434 | m3596 | 44.4 ± 4* | 27.7 ± 4.5* |
| MET-3435 | 3435 | m3597 | 63.4 ± 13.6* | 46 ± 11.7* |
| MET-3436 | 3436 | m3598 | 81.9 ± 5.5* | 71.3 ± 15.1* |
| MET-3437 | 3437 | m3599 | 45.6 ± 4.3* | 32.6 ± 9.7* |
| MET-3438 | 3438 | m3600 | 43.1 ± 1.8* | 27.8 ± 1.9* |
| MET-3439 | 3439 | m3601 | 45.3 ± 6.4* | 33.8 ± 5.4* |
| MET-3440 | 3440 | m3602 | 58.6 ± 16.1* | 62.8 ± 4.5* |
| MET-3441 | 3441 | m3603 | 83.6 ± 9.7* | 64.5 ± 5* |
| MET-3442 | 3442 | m3604 | 69.4 ± 2.9* | 46 ± 3* |
| MET-3443 | 3443 | m3605 | 69.3 ± 9.4* | 46.9 ± 9.2* |

TABLE 12-continued

MET Inhibitory Efficacy of DsiRNAs Assayed at 1 nM in Mouse HEPA1-6 Cells

| DsiRNA Name (Human MET Target Location, Transcript Variant 1) | Human MET Target Location, Transcript Variant 2 | Mouse MET Target Location/DsiRNA Name | % Remaining MET mRNA ± % Error (Assay: Mm MET 230-363) | % Remaining MET mRNA ± % Error (Assay: Mm MET 5969-6087) |
|---|---|---|---|---|
| MET-3444 | 3444 | m3606 | 49.5 ± 1.6* | 37.9 ± 1.6* |
| MET-3445 | 3445 | m3607 | 45.3 ± 1.9* | 36.9 ± 2.6* |
| MET-3446 | 3446 | m3608 | 80.6 ± 2.9* | 60.6 ± 2.8* |
| MET-3447 | 3447 | m3609 | 67.8 ± 3.1* | 64.1 ± 4.6* |
| MET-3448 | 3448 | m3610 | 51.7 ± 12.9* | 69.4 ± 3.5* |
| MET-3449 | 3449 | m3611 | 76.3 ± 10.5* | 67.1 ± 6.6* |
| MET-3450 | 3450 | m3612 | 71.8 ± 4.8* | 54.9 ± 8.1* |
| MET-3451 | 3451 | m3613 | 84.6 ± 6.9* | 66 ± 6.9* |
| MET-3452 | 3452 | m3614 | 64.8 ± 6.4* | 56 ± 7.1* |
| MET-3453 | 3453 | m3615 | 104.2 ± 10.2* | 91.7 ± 3.2* |
| MET-3454 | 3454 | m3616 | 131.4 ± 12.9* | 89.4 ± 12.4* |
| MET-3455 | 3455 | m3617 | 87.5 ± 9* | 83.3 ± 13.7* |
| MET-3456 | 3456 | m3618 | 115.3 ± 14.9* | 86.3 ± 11.5* |
| MET-3457 | 3457 | m3619 | 77.8 ± 2.6* | 75.5 ± 6.8* |
| MET-3458 | 3458 | m3620 | 82.2 ± 8* | 70.3 ± 9* |
| MET-3459 | 3459 | m3621 | 130 ± 9.1* | 111.7 ± 0.8* |
| MET-3460 | 3460 | m3622 | 129.5 ± 2.2* | 109.5 ± 5.7* |
| MET-3461 | 3461 | m3623 | 142.2 ± 7.8* | 100.9 ± 8* |
| MET-3518 | 3518 | m3680 | 119.3 ± 7.1* | 86.9 ± 3.8* |
| MET-3519 | 3519 | m3681 | 79.3 ± 11.1* | 78.3 ± 4.9* |
| MET-3520 | 3520 | m3682 | 89 ± 7* | 63 ± 5* |
| MET-3521 | 3521 | m3683 | 75.5 ± 3.5* | 70 ± 4.5* |
| MET-3522 | 3522 | m3684 | 85.3 ± 4* | 60.7 ± 4.8* |
| MET-3523 | 3523 | m3685 | 92.1 ± 5.4* | 74.6 ± 5.9* |
| MET-3524 | 3524 | m3686 | 61.1 ± 4.2* | 42.5 ± 4.7* |
| MET-3525 | 3525 | m3687 | 46.3 ± 20.3* | 33.9 ± 11.5* |
| MET-3526 | 3526 | m3688 | 62.1 ± 4.8* | 46.4 ± 0.9* |
| MET-3527 | 3527 | m3689 | 37.3 ± 6.2* | 37 ± 10* |
| MET-3528 | 3528 | m3690 | 57.3 ± 1.3* | 40.8 ± 4.1* |
| MET-3590 | 3590 | m3752 | 58 ± 9.6* | 56.2 ± 6.7* |
| MET-3591 | 3591 | m3753 | 75.5 ± 10.2* | 62.7 ± 2.1* |
| MET-3725 | 3725 | m3887 | 101.8 ± 5.9* | 75 ± 2.4* |
| MET-3726 | 3726 | m3888 | 51.4 ± 5.8* | 37 ± 6* |
| MET-3767 | 3767 | m3929 | 76.9 ± 8.3* | 57.1 ± 12.6* |
| MET-3768 | 3768 | m3930 | 56.8 ± 18.6* | 30.7 ± 20.3* |
| MET-3769 | 3769 | m3931 | 41 ± 12.1* | 34.2 ± 16* |
| MET-3770 | 3770 | m3932 | 56.7 ± 11.5* | 35.4 ± 18.4* |
| MET-3771 | 3771 | m3933 | 56.9 ± 13.7* | 37.6 ± 10.2* |
| MET-3772 | 3772 | m3934 | 45.4 ± 12.6* | 25.7 ± 13.9* |
| MET-3773 | 3773 | m3935 | 33.2 ± 3.9* | 18.9 ± 1.8* |
| MET-3774 | 3774 | m3936 | 111.2 ± N/A* | 94 ± N/A* |
| MET-3775 | 3775 | m3937 | 91.9 ± 4.3* | 71.5 ± 1.8* |
| MET-3776 | 3776 | m3938 | 58.9 ± 8.3* | 38.1 ± 3.7* |
| MET-3777 | 3777 | m3939 | 64.5 ± 4.7* | 56 ± 5* |
| MET-3778 | 3778 | m3940 | 75.4 ± 2.8* | 74.5 ± 3.8* |
| MET-3779 | 3779 | m3941 | 102.9 ± 5.6* | 89.9 ± 7.7* |
| MET-3780 | 3780 | m3942 | 86.3 ± 7.8* | 65.6 ± 4.7* |
| MET-3800 | 3800 | m3962 | 64.4 ± 2.2* | 50.5 ± 6.4* |
| MET-3801 | 3801 | m3963 | 41.5 ± 7* | 30.8 ± 4.9* |
| MET-3802 | 3802 | m3964 | 49.4 ± 11.8* | 39.4 ± 9.6* |
| MET-3803 | 3803 | m3965 | 54.2 ± 6* | 37 ± 4.2* |
| MET-3804 | 3804 | m3966 | 61.9 ± 9.2* | 53.2 ± 11.3* |
| MET-3805 | 3805 | m3967 | 59.1 ± 6* | 49.5 ± 3* |
| MET-3806 | 3806 | m3968 | 57.3 ± 4.6* | 46.4 ± 6.8* |
| MET-3807 | 3807 | m3969 | 70.5 ± 3.9* | 45.8 ± 12.8* |
| MET-3881 | 3881 | m4043 | 41.3 ± 8.2* | 32.8 ± 2.1* |
| MET-3882 | 3882 | m4044 | 41.9 ± 4.2* | 30.9 ± 2.1* |
| MET-4265 | 4265 | m4427 | 49.7 ± 15.5* | 21.2 ± 22.7* |
| MET-4266 | 4266 | m4428 | 54.4 ± 16.7* | 20.3 ± 18.3* |
| MET-4521 | 4521 | m4710 | 68.8 ± 15.9* | 42.6 ± 12.7* |
| MET-4522 | 4522 | m4711 | 66.1 ± 8.6* | 37.7 ± 10.1* |
| MET-4881 | 4881 | m5054 | 81.3 ± 9.6* | 41.9 ± 9.5* |
| MET-5793 | 5793 | m5824 | 69.2 ± 7.2* | 34.6 ± 10.8* |
| MET-5813 | 5813 | m5844 | 112.3 ± 14.8* | 59.3 ± 18.7* |
| MET-5814 | 5814 | m5845 | 108.3 ± 17.9*† | 65.6 ± 25.4*† |
| MET-5893 | 5893 | m5923 | 164.8 ± 10.3* | 92.4 ± 6.2* |
| MET-5894 | 5894 | m5924 | 124.2 ± 12.4* | 75.8 ± 6.3* |
| MET-6021 | 6021 | m6054 | 51.3 ± 6.5* | 28.5 ± 3.3* |
| MET-6022 | 6022 | m6055 | 58.8 ± 7.4* | 30.2 ± 2.6* |
| MET-6023 | 6023 | m6056 | 6.3 ± 10.9* | 52 ± 3* |
| MET-6024 | 6024 | m6057 | 76.4 ± 5.9* | 36.6 ± 3.9* |
| MET-6025 | 6025 | m6058 | 61 ± 4.3* | 23 ± 3.2* |

TABLE 12-continued

MET Inhibitory Efficacy of DsiRNAs Assayed at 1 nM in Mouse HEPA1-6 Cells

| DsiRNA Name (Human MET Target Location, Transcript Variant 1) | Human MET Target Location, Transcript Variant 2 | Mouse MET Target Location/DsiRNA Name | % Remaining MET mRNA ± % Error (Assay: Mm MET 230-363) | % Remaining MET mRNA ± % Error (Assay: Mm MET 5969-6087) |
|---|---|---|---|---|
| MET-6026 | 6026 | m6059 | 62.7 ± 6.6* | 28.1 ± 4* |
| MET-6070 | 6070 | m6103 | 70.4 ± 5* | 36.3 ± 2.2* |
| MET-6071 | 6071 | m6104 | 91.5 ± 11.8* | 41.4 ± 13* |
| MET-6072 | 6072 | m6105 | 50.8 ± 10.1* | 27.9 ± 6* |
| MET-6073 | 6073 | m6106 | 44 ± 15.1* | 22.4 ± 10.6* |
| MET-6074 | 6074 | m6107 | 62.3 ± 8.4* | 32.4 ± 10.3* |
| MET-6545 | 6545 | m6567 | 66.5 ± 6.1* | 35.5 ± 6.4* |
| MET-6546 | 6546 | m6568 | 55 ± 6.9* | 26.8 ± 3.8* |
| MET-6547 | 6547 | m6569 | 49.6 ± 16* | 27.1 ± 7.8* |
| | | MET-m65 | 114.7 ± 6.2 | 106.1 ± 8.7 |
| | | MET-m102 | 97.9 ± 2.1 | 99.1 ± 5.7 |
| | | MET-m106 | 102.4 ± 2.8 | 100.5 ± 2.2 |
| | | MET-m114 | 76.9 ± 1.7 | 75.9 ± 1.9 |
| | | MET-m115 | 163.8 ± 4.7 | 117.2 ± 2 |
| | | MET-m117 | 172.1 ± 4.5 | 107.7 ± 7.2 |
| | | MET-m167 | 109 ± 6.2 | 96 ± 5.6 |
| | | MET-m169 | 113.7 ± 2.2 | 85.7 ± 5 |
| | | MET-m171 | 87.8 ± 3.3 | 88.2 ± 1.7 |
| | | MET-m335 | 32.6 ± 1.8 | 35.6 ± 4.2 |
| | | MET-m336 | 52.3 ± 1.3 | 51.9 ± 0.8 |
| | | MET-m400 | 109.1 ± 9.9 | 86.8 ± 10.6 |
| | | MET-m402 | 81.7 ± 14.9 | 67.1 ± 9.8 |
| | | MET-m403 | 101.4 ± 7 | 85.1 ± 3.4 |
| | | MET-m413 | 23.5 ± 2.6 | 25.4 ± 3.3 |
| | | MET-m415 | 43.7 ± 2.2 | 39.8 ± 2.9 |
| | | MET-m416 | 31.9 ± 3.2 | 30.3 ± 1.6 |
| | | MET-m419 | 22.4 ± 3.6 | 21.8 ± 1 |
| | | MET-m1221 | 71.6 ± 2.4 | 72.9 ± 12.1 |
| | | MET-m1561 | 67.5 ± 5 | 64.1 ± 1.3 |
| | | MET-m1590 | 114.6 ± 16.9 | 98.2 ± 10.2 |
| | | MET-m1592 | 74.2 ± 6.7 | 73.2 ± 3.9 |
| | | MET-m1636 | 56.6 ± 5.3 | 51.6 ± 1.5 |
| | | MET-m1638 | 37.4 ± 10.4 | 41.2 ± 8.8 |
| | | MET-m1641 | 35.4 ± 7.5 | 28.1 ± 4.6 |
| | | MET-m1643 | 19 ± 10.3 | 21.3 ± 9.6 |
| | | MET-m1644 | 18.7 ± 2.7 | 14.3 ± 3.5 |
| | | MET-m1645 | 43.4 ± 3.8 | 36.8 ± 3.8 |
| | | MET-m1646 | 75.7 ± 7.2 | 56.7 ± 4.9 |
| | | MET-m1653 | 72.4 ± 7.6 | 68.3 ± 6.2 |
| | | MET-m1757 | 83.2 ± 3.9 | 96.1 ± 3.8 |
| | | MET-m1769 | 67.5 ± 5.2 | 75.5 ± 7.5 |
| | | MET-m1771 | 89 ± 2.2 | 68 ± 2.5 |
| | | MET-m2188 | 40.3 ± 3.1 | 33.4 ± 2.8 |
| | | MET-m2779 | 25.1 ± 7.6 | 20.7 ± 15.4 |
| | | MET-m3113 | 47.7 ± 9.7 | 30.2 ± 13 |
| | | MET-m3114 | 32.1 ± 9.5 | 22.5 ± 5.8 |
| | | MET-m3119 | 39.1 ± 2.6 | 25.6 ± 4.3 |
| | | MET-m3573 | 119.5 ± 9.4 | 81.2 ± 4.8 |
| | | MET-m3588 | 62.2 ± 3.8 | 44.9 ± 1.8 |
| | | MET-m4025 | 31.1 ± 2.9 | 27 ± 2.3 |
| | | MET-m4032 | 70.5 ± 1.3 | 52 ± 3.8 |
| | | MET-m4100 | 123.3 ± 11.5 | 86.6 ± 6.7 |
| | | MET-m4104 | 66.9 ± 6.6 | 44.3 ± 6.7 |
| | | MET-m4105 | 46.1 ± 1.6 | 44.7 ± 1.4 |
| | | MET-m4179 | 145.5 ± 2.7 | 117.4 ± 5.6 |
| | | MET-m4180 | 164.2 ± 4.7 | 141.2 ± 7 |
| | | MET-m4182 | 135.7 ± 7.1 | 86.3 ± 2.4 |
| | | MET-m4639 | 28.7 ± 6.8 | 18.7 ± 11 |
| | | MET-m4640 | 31.3 ± 6.1 | 21 ± 7.9 |
| | | MET-m4641 | 42.7 ± 2.8 | 24.8 ± 4.4 |
| | | MET-m4642 | 49 ± 8 | 33.7 ± 4.3 |
| | | MET-m4643 | 80.5 ± 4.7 | 61.7 ± 5.2 |
| | | MET-m4645 | 26.7 ± N/A | 12.7 ± N/A |
| | | MET-m4646 | 31.8 ± 1.1 | 17.3 ± 3.9 |
| | | MET-m4647 | 38.7 ± 1.5 | 21.1 ± 2.3 |
| | | MET-m4648 | 49 ± 3.1 | 25.7 ± 7.1 |
| | | MET-m4649 | 53 ± 7.7 | 30 ± 7.1 |
| | | MET-m4650 | 37.3 ± 2.4 | 16.7 ± 1 |
| | | MET-m4651 | 23.7 ± 12.6 | 16.7 ± 11.1 |
| | | MET-m4652 | 52.3 ± 7.7 | 23.7 ± 3.2 |
| | | MET-m4653 | 27.6 ± 7.7 | 12.9 ± 4.1 |
| | | MET-m4654 | 51.7 ± 14.6 | 25.8 ± 11.4 |

TABLE 12-continued

MET Inhibitory Efficacy of DsiRNAs Assayed at 1 nM in Mouse HEPA1-6 Cells

| DsiRNA Name (Human MET Target Location, Transcript Variant 1) | Human MET Target Location, Transcript Variant 2 | Mouse MET Target Location/DsiRNA Name | % Remaining MET mRNA ± % Error (Assay: Mm MET 230-363) | % Remaining MET mRNA ± % Error (Assay: Mm MET 5969-6087) |
|---|---|---|---|---|
| | | MET-m4655 | 45.6 ± 6 | 33.6 ± 2.7 |
| | | MET-m4656 | 41.1 ± 9.3 | 17.5 ± 8.7 |
| | | MET-m4659 | 27.2 ± 4.6 | 16.5 ± 2 |
| | | MET-m5255 | 40.5 ± 8.7 | 23 ± 0.9 |
| | | MET-m5259 | 47.5 ± 10.9 | 14.3 ± 5 |
| | | MET-m5835 | 34.4 ± 8.7 | 24.6 ± 3.5 |
| | | MET-m5836 | 29.5 ± 4.2 | 21 ± 2.5 |
| | | MET-m5837 | 34.1 ± 3.3 | 14.3 ± 2 |
| | | MET-m5839 | 31.9 ± 3.7 | 13 ± 1.7 |

*Subpar transfections
†Normalized to Rpl23 only

As shown in above Table 11, 295 of 360 asymmetric DsiRNAs examined in human HeLa cells showed greater than 70% reduction of human MET levels in HeLa cells at 1 nM. Of these 295 DsiRNAs, 242 exhibited 80% or greater reduction of human MET levels in HeLa cells at 1 nM. As shown in above Table 12, a number of asymmetric DsiRNAs capable of inhibiting mouse MET levels in mouse HEPA1-6 cells at 1 nM in the environment of a cell were also identified in such assays. Assay results of Tables 11 and 12 above were also plotted and are shown in FIGS. 2-1 to 2-4. It is noted in Table 12 and corresponding FIG. 2-4 that assays ranging from MET-3165 through MET-6547 were affected by subpar transfection of Hepa1-6 cells in these assays.

In certain embodiments, double stranded nucleic acids were selected that target the following 21 nucleotide target sequences in MET mRNA:

TABLE 13

MET 21 Nucleotide mRNA Target Sequences of Select dsRNAs

| Human MET Target Location, Transcript Variant 1 | 21 Nucleotide Target Sequence | SEQ ID NO: |
|---|---|---|
| MET-159 | UUGCGCCGCUGACUUCUCCAC | 1451 |
| MET-248 | UCGUGCUCCUGUUUACCUUGG | 1456 |
| MET-413 | CUAACUACAUUUAUGUUUUAA | 1459 |
| MET-416 | ACUACAUUUAUGUUUUAAAUG | 1462 |
| MET-586 | UACUAUGAUGAUCAACUCAUU | 1472 |
| MET-590 | AUGAUCAACUCAUUAGCU | 1476 |
| MET-881 | AAGAUGGUUUUAUGUUUUUGA | 1484 |
| MET-1040 | CAAGAAUAAUCAGGUUCUGUU | 1495 |
| MET-1042 | AGAAUAAUCAGGUUCUGUUCC | 1497 |
| MET-1144 | AAGGAAGUGUUUAAUAUACUU | 1500 |
| MET-1253 | CACAAAGCAAGCCAGAUUCUG | 1505 |
| MET-1362 | GAGAUGUCUCCAGCAUUUUUA | 1511 |
| MET-1474 | ACCACAGCUUUGCAGCGCGUU | 1524 |

TABLE 13-continued

MET 21 Nucleotide mRNA Target Sequences of Select dsRNAs

| Human MET Target Location, Transcript Variant 1 | 21 Nucleotide Target Sequence | SEQ ID NO: |
|---|---|---|
| MET-1961 | UAUGUGGCUGGGACUUUGGAU | 1538 |
| MET-1982 | UUCGGAGGAAUAAUAAAUUUG | 1540 |
| MET-2290 | GGUGGAAAAACAUGUACUUUA | 1546 |
| MET-2790 | UAAGCCUUUUGAAAAGCCAGU | 1548 |
| MET-2856 | UGAUAUUGACCCUGAAGCAGU | 1549 |
| MET-2879 | AAGGUGAAGUGUUAAAAGUUG | 1572 |
| MET-2882 | GUGAAGUGUUAAAAGUUGGAA | 1575 |
| MET-2987 | UAAAUAUAGAGUGGAAGCAAG | 1592 |
| MET-3126 | GUGGCUGAAAAAGAGAAAGCA | 1596 |
| MET-3150 | UAAAGAUCUGGGCAGUGAAUU | 1599 |
| MET-3276 | CCGAGCUACUUUUCCAGAAGA | 1633 |
| MET-3419 | UCCACAUUGACCUCAGUGCUC | 1634 |
| MET-3434 | GUGCUCUAAAUCCAGAGCUGG | 1649 |
| MET-3492 | CCUGAUUGUGCAUUUCAAUGA | 1658 |
| MET-3496 | AUUGUGCAUUUCAAUGAAGUC | 1662 |
| MET-3512 | AAGUCAUAGGAAGAGGGCAUU | 1678 |
| MET-3576 | GAAAAUUCACUGUGCUGUGAA | 1686 |
| MET-3582 | UCACUGUGCUGUGAAAUCCUU | 1692 |
| MET-3780 | UGAGACUCAUAAUCCAACUGU | 1696 |
| MET-3834 | CAAAGGCAUGAAAUAUCUUGC | 1712 |
| MET-3854 | CAAGCAAAAGUUUGUCCACA | 1713 |
| MET-3917 | CAGUCAAGGUUGCUGAUUUUG | 1726 |
| MET-3922 | AAGGUUGCUGAUUUUGGUCUU | 1727 |
| MET-3935 | UUGGUCUUGCCAGAGACAUGU | 1729 |

TABLE 13-continued

MET 21 Nucleotide mRNA Target Sequences of Select dsRNAs

| Human MET Target Location, Transcript Variant 1 | 21 Nucleotide Target Sequence | SEQ ID NO: |
|---|---|---|
| MET-4011 | GUGGAUGGCUUUGGAAAGUCU | 1734 |
| MET-4320 | UGUGAACGCUACUUAUGUGAA | 1742 |
| MET-4576 | ACUGGAUUCUAAGGAAUUUCU | 1747 |
| MET-4935 | GUAAACAUUCCCUUUUAAAUG | 1749 |
| MET-4947 | UUUUAAAUGUUUGUUUGUUUU | 1750 |
| MET-5094 | CCGGCUAAUUUUUGUAUUUUU | 1758 |
| MET-5234 | CCUUAUAAAUUUUGUAUAGA | 1759 |
| MET-5357 | AUGACAUUAAGAAAAUUUGUA | 1762 |
| MET-5548 | AACUCAGCAUGUUUGUAAAGC | 1764 |
| MET-5634 | UGGAUGGAUUGAAAAGAUUAG | 1765 |
| MET-5847 | AUUCUGUGGAAUUUUGUGCUU | 1766 |
| MET-5848 | UUCUGUGGAAUUUUGUGCUUG | 1767 |
| MET-5919 | UAAACAUUUAAAGUGUUAUAU | 1780 |
| MET-6520 | UUUGCUAUUUAUAAACUUGUC | 1797 |
| MET-6600 | CUUGUCACUGCCUAUACCUGC | 1799 |

TABLE 14

MET 21 Nucleotide mRNA Target Sequences of Further Select dsRNAs

| Human MET Target Location, Transcript Variant 1 | 21 Nucleotide Target Sequence | SEQ ID NO: |
|---|---|---|
| MET-586 | UACUAUGAUGAUCAACUCAUU | 1472 |
| MET-1961 | UAUGUGGCUGGGACUUUGGAU | 1538 |
| MET-1982 | UUCGGAGGAAUAAUAAAUUUG | 1540 |
| MET-2856 | UGAUAUUGACCCUGAAGCAGU | 1549 |
| MET-2882 | GUGAAGUGUUAAAAGUUGGAA | 1575 |
| MET-3492 | CCUGAUUGUGCAUUUCAAUGA | 1658 |
| MET-3488 | GUAGCCUGAUUGUGCAUUUCA | 1654 |
| MET-3582 | UCACUGUGCUGUGAAAUCCUU | 1692 |
| MET-3780 | UGAGACUCAUAAUCCAACUGU | 1696 |
| MET-3922 | AAGGUUGCUGAUUUUGGUCUU | 1727 |
| MET-4011 | GUGGAUGGCUUUGGAAAGUCU | 1734 |
| MET-5265 | GUUGGAAGAAUAUUUAUAGGC | 1760 |
| MET-5357 | AUGACAUUAAGAAAAUUUGUA | 1762 |
| MET-5548 | AACUCAGCAUGUUUGUAAAGC | 1764 |

TABLE 14-continued

MET 21 Nucleotide mRNA Target Sequences of Further Select dsRNAs

| Human MET Target Location, Transcript Variant 1 | 21 Nucleotide Target Sequence | SEQ ID NO: |
|---|---|---|
| MET-5847 | AUUCUGUGGAAUUUUGUGCUU | 1766 |
| MET-6600 | CUUGUCACUGCCUAUACCUGC | 1799 |

TABLE 15

MET 21 Nucleotide mRNA Target Sequences of Additional Select dsRNAs

| Human MET Target Location, Transcript Variant 1 | 21 Nucleotide Target Sequence | SEQ ID NO: |
|---|---|---|
| MET-1961 | UAUGUGGCUGGGACUUUGGAU | 1538 |
| MET-1982 | UUCGGAGGAAUAAUAAAUUUG | 1540 |
| MET-2856 | UGAUAUUGACCCUGAAGCAGU | 1549 |
| MET-2882 | GUGAAGUGUUAAAAGUUGGAA | 1575 |
| MET-5357 | AUGACAUUAAGAAAAUUUGUA | 1762 |
| MET-5548 | AACUCAGCAUGUUUGUAAAGC | 1764 |
| MET-6600 | CUUGUCACUGCCUAUACCUGC | 1799 |

TABLE 16

MET 21 Nucleotide mRNA Target Sequences of Selected dsRNAs

| Human MET Target Location, Transcript Variant 1 | 21 Nucleotide Target Sequence | SEQ ID NO: |
|---|---|---|
| MET-586 | UACUAUGAUGAUCAACUCAUU | 1472 |
| MET-3488 | GUAGCCUGAUUGUGCAUUUCA | 1654 |
| MET-3492 | CCUGAUUGUGCAUUUCAAUGA | 1658 |
| MET-3582 | UCACUGUGCUGUGAAAUCCUU | 1692 |
| MET-3780 | UGAGACUCAUAAUCCAACUGU | 1696 |
| MET-3922 | AAGGUUGCUGAUUUUGGUCUU | 1727 |
| MET-4011 | GUGGAUGGCUUUGGAAAGUCU | 1734 |
| MET-5265 | GUUGGAAGAAUAUUUAUAGGC | 1760 |
| MET-5847 | AUUCUGUGGAAUUUUGUGCUU | 1766 |

TABLE 17

MET 21 Nucleotide mRNA Target Sequences of Additional Selected dsRNAs

| Human MET Target Location, Transcript Variant 1 | 21 Nucleotide Target Sequence | SEQ ID NO: |
|---|---|---|
| MET-1961 | UAUGUGGCUGGGACUUUGGAU | 1538 |
| MET-1982 | UUCGGAGGAAUAAUAAAUUUG | 1540 |
| MET-2856 | UGAUAUUGACCCUGAAGCAGU | 1549 |
| MET-2882 | GUGAAGUGUUAAAAGUUGGAA | 1575 |
| MET-3582 | UCACUGUGCUGUGAAAUCCUU | 1692 |
| MET-3780 | UGAGACUCAUAAUCCAACUGU | 1696 |
| MET-5357 | AUGACAUUAAGAAAAUUUGUA | 1762 |
| MET-5548 | AACUCAGCAUGUUUGUAAAGC | 1764 |
| MET-6600 | CUUGUCACUGCCUAUACCUGC | 1799 |

TABLE 18

MET 21 Nucleotide mRNA Target Sequences of Further Selected dsRNAs

| Human MET Target Location, Transcript Variant 1 | 21 Nucleotide Target Sequence | SEQ ID NO: |
|---|---|---|
| MET-586 | UACUAUGAUGAUCAACUCAUU | 1472 |
| MET-3488 | GUAGCCUGAUUGUGCAUUUCA | 1654 |
| MET-3492 | CCUGAUUGUGCAUUUCAAUGA | 1658 |
| MET-3922 | AAGGUUGCUGAUUUUGGUCUU | 1727 |
| MET-4011 | GUGGAUGGCUUUGGAAAGUCU | 1734 |
| MET-5265 | GUUGGAAGAAUAUUUAUAGGC | 1760 |
| MET-5847 | AUUCUGUGGAAUUUUGUGCUU | 1766 |

Example 3

Figures 1, 2:
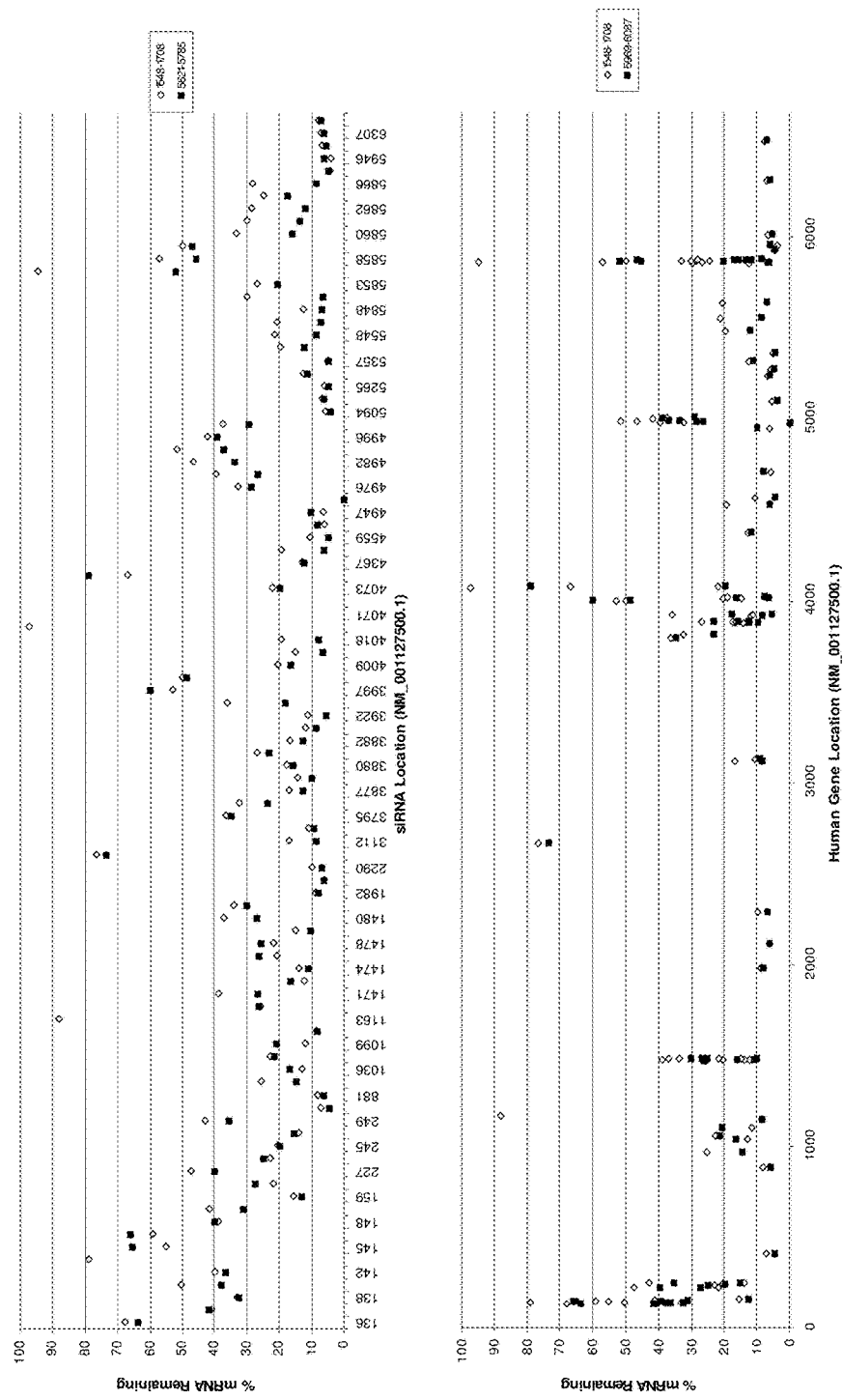
Figure 2:
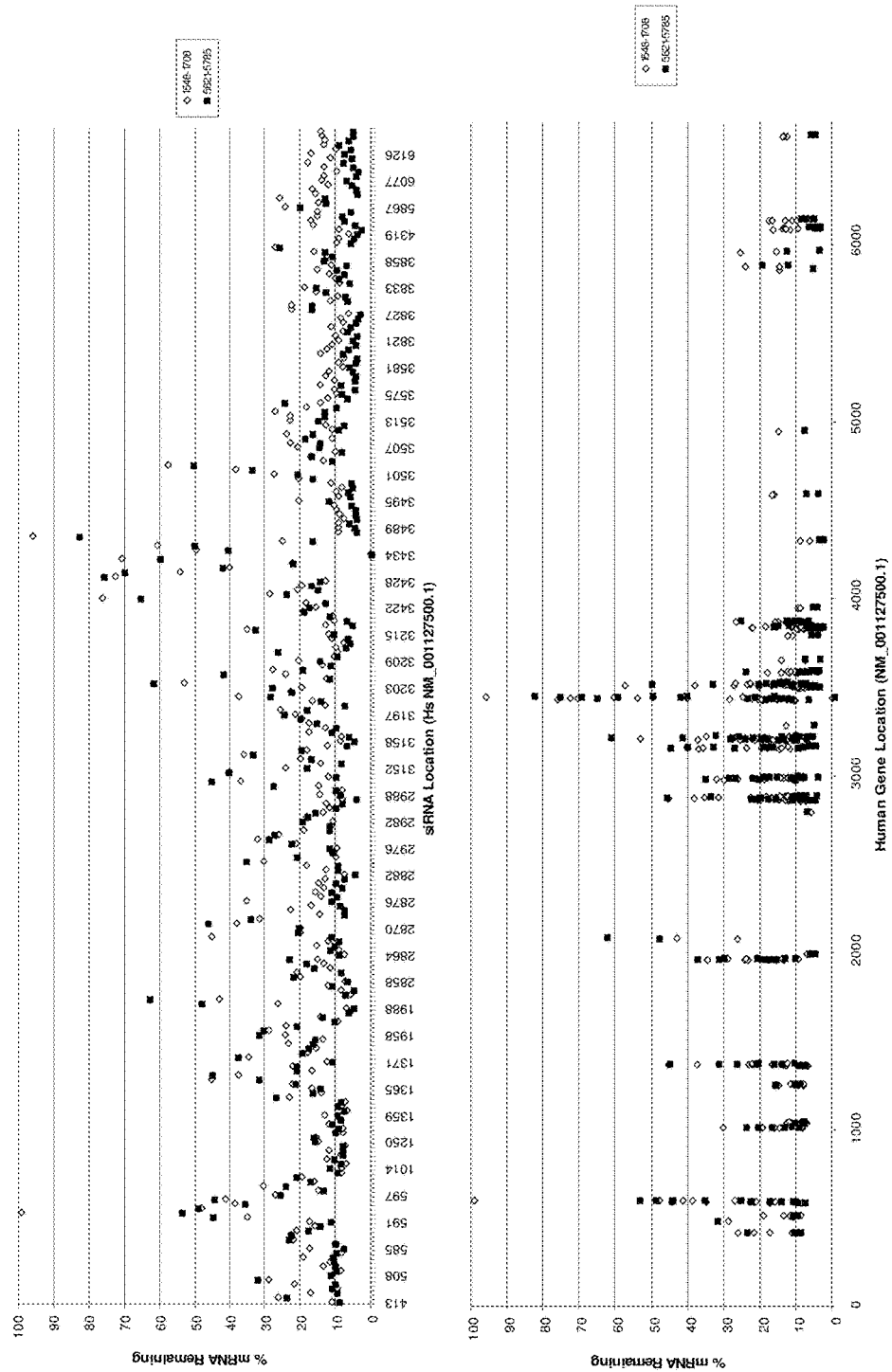
Figures 2, 3:
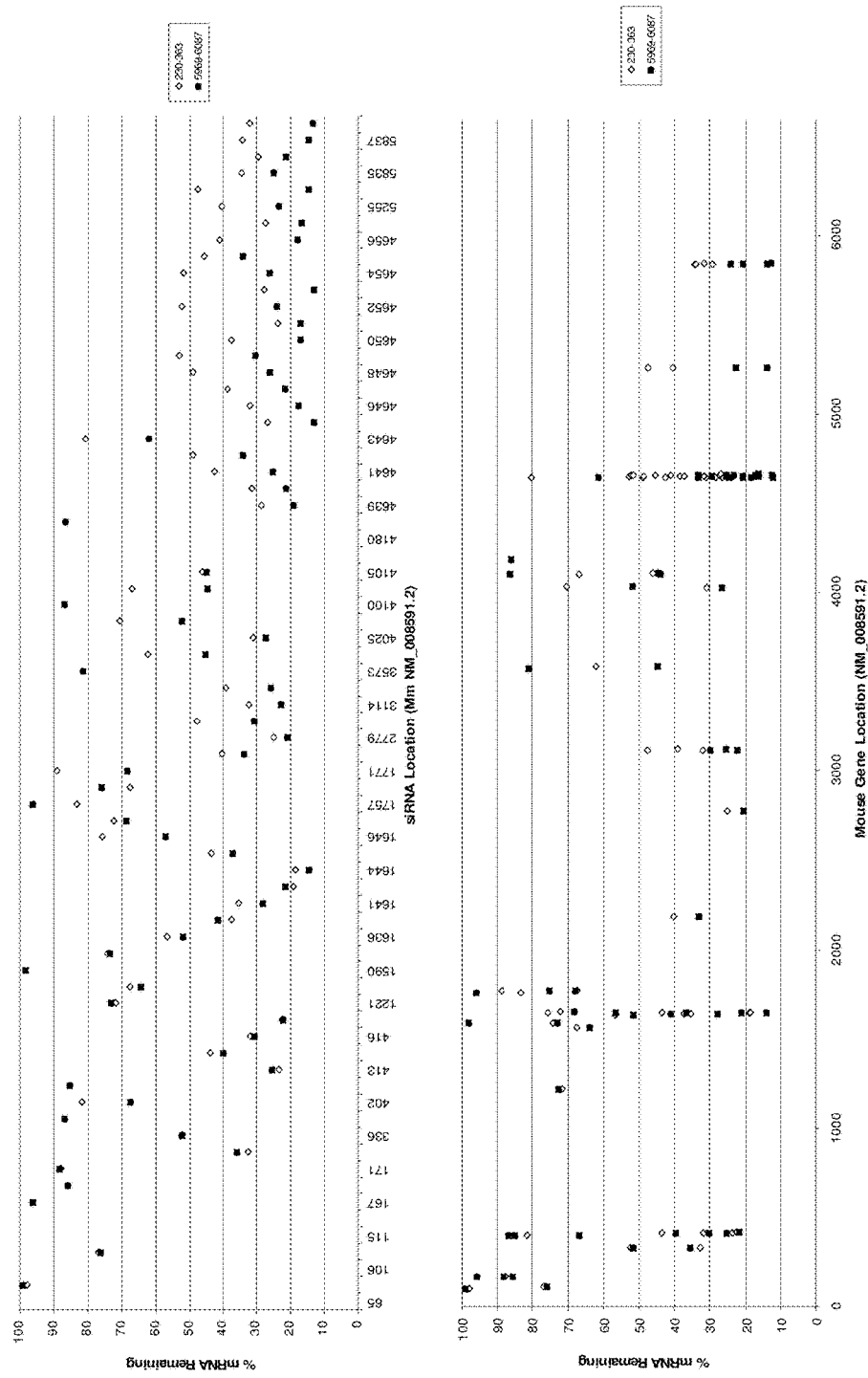
Figures 2, 3, 4:
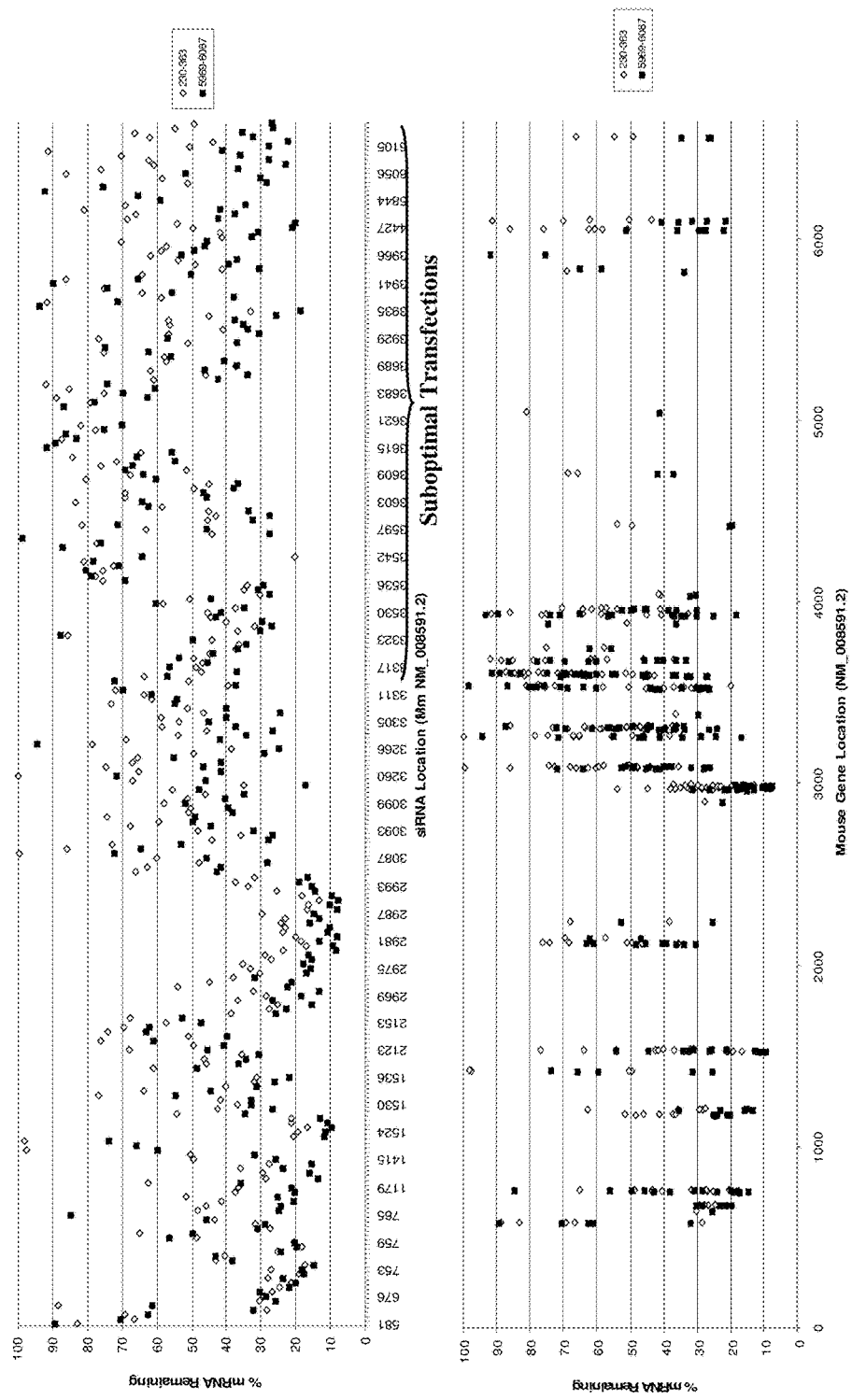
Figures 1, 3:
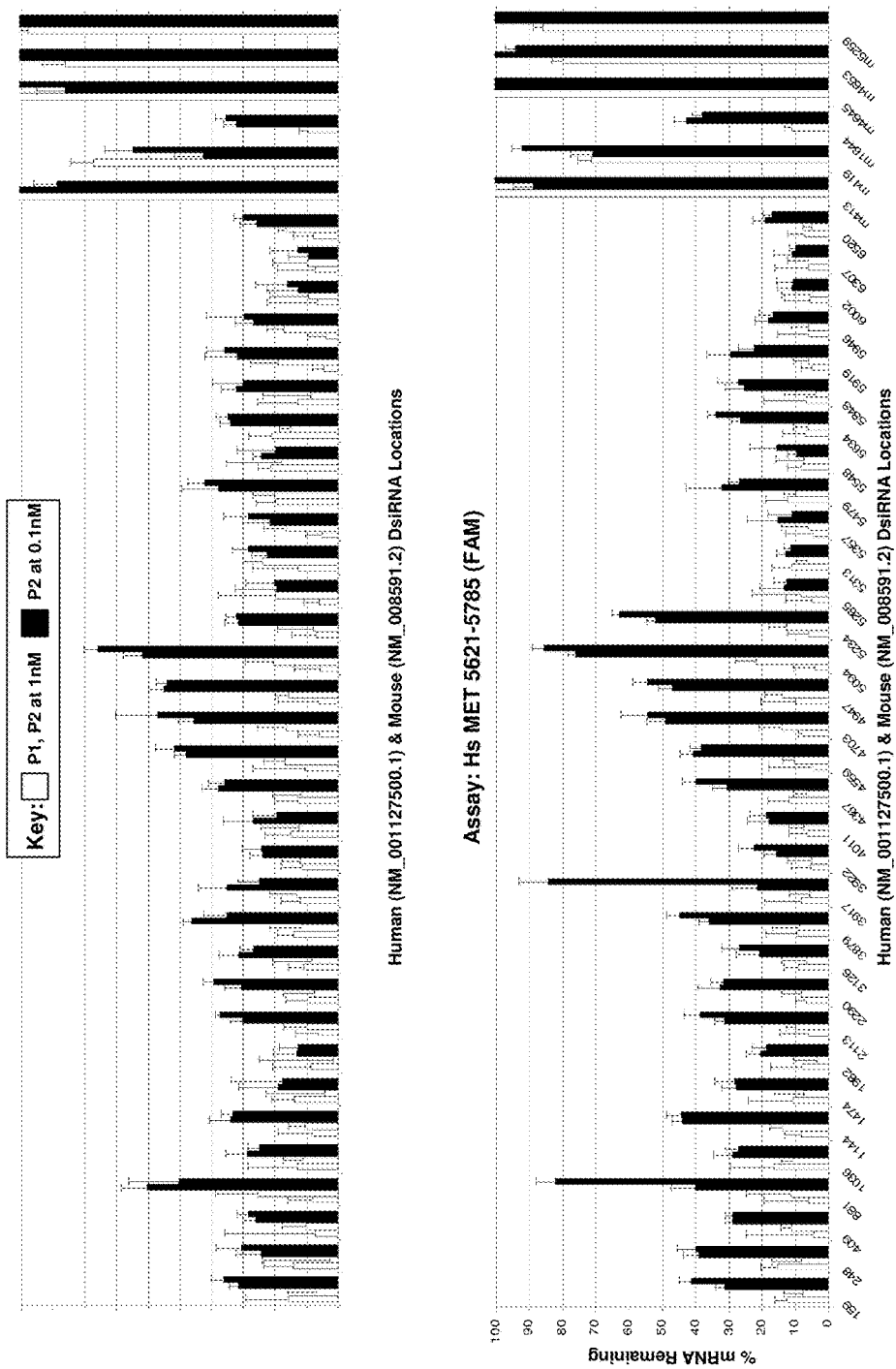
Figures 2, 3:
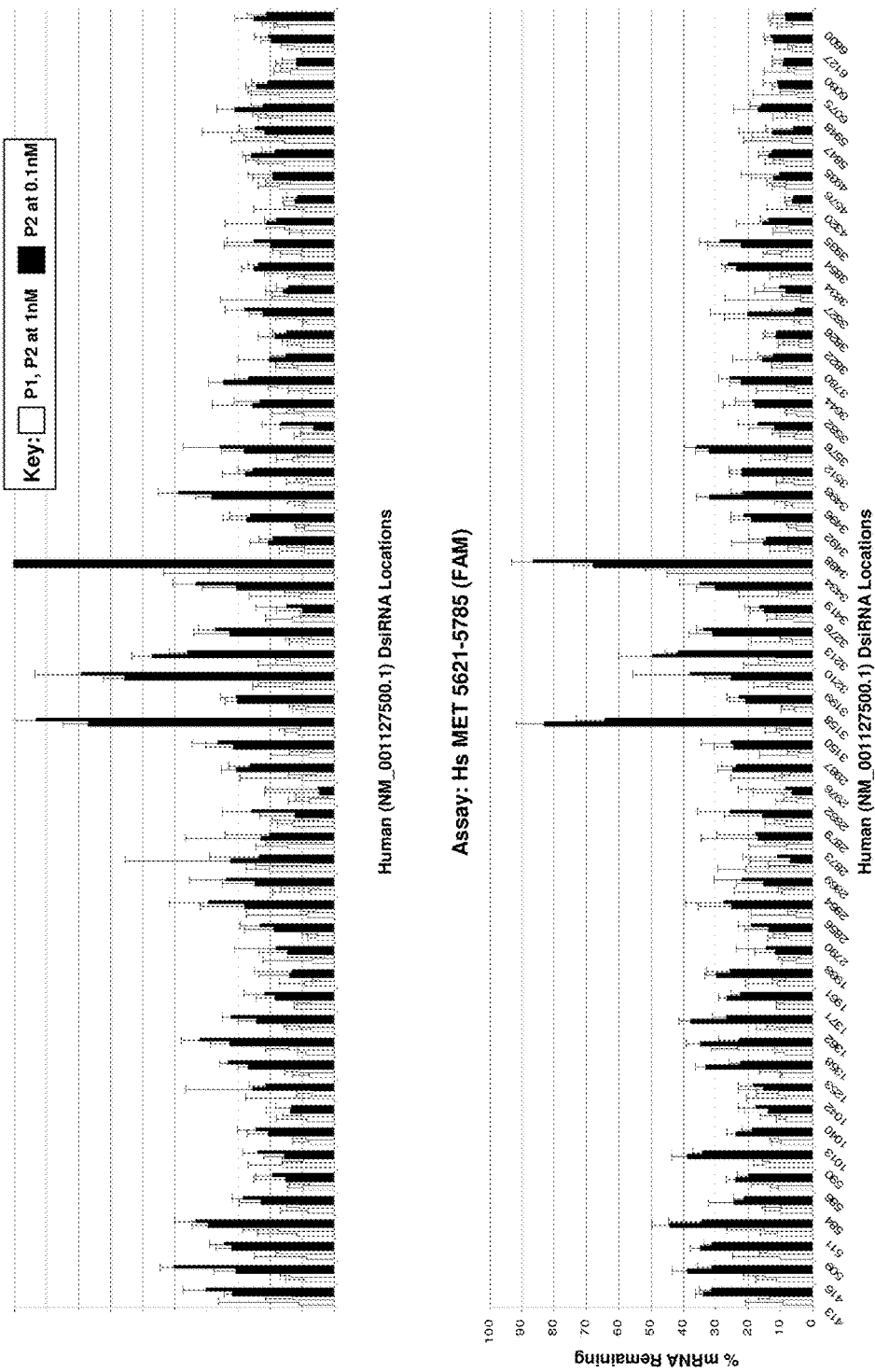
Figure 3:
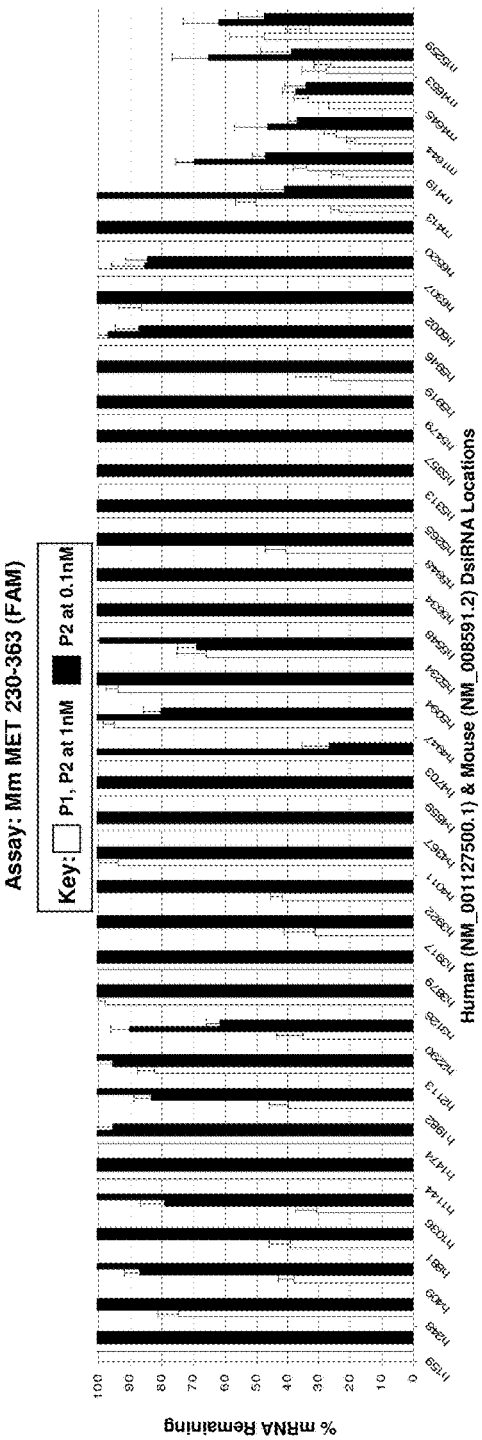
Figure 3:
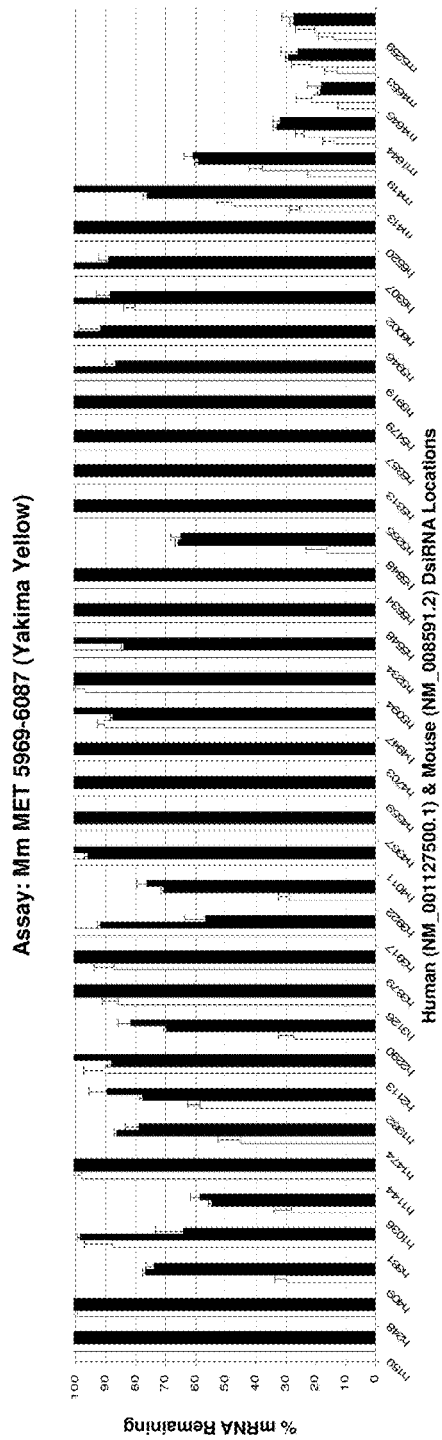
Figures 1, 4:
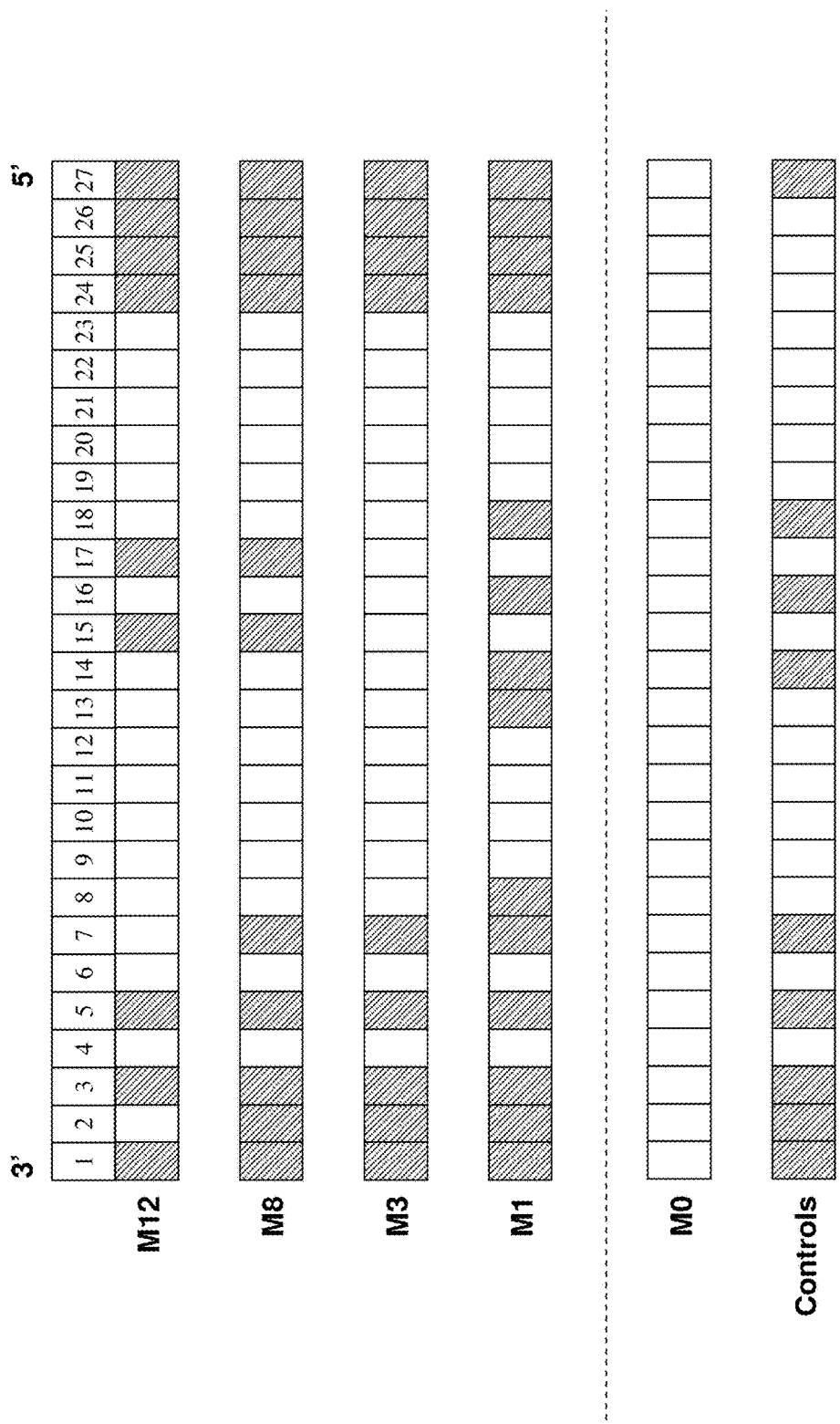
Figure 4:
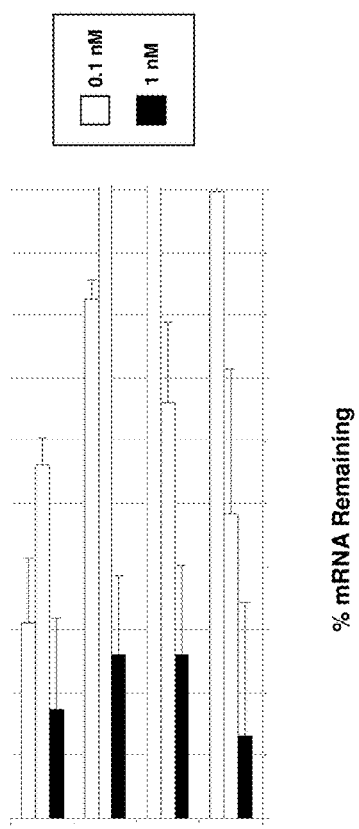
Figure 3:
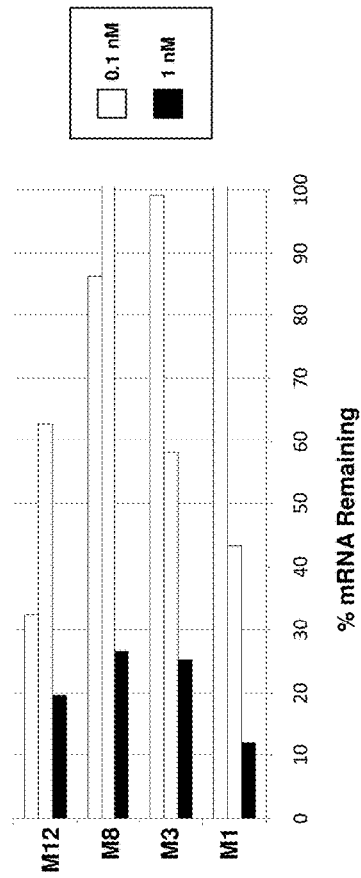
Figure 4:
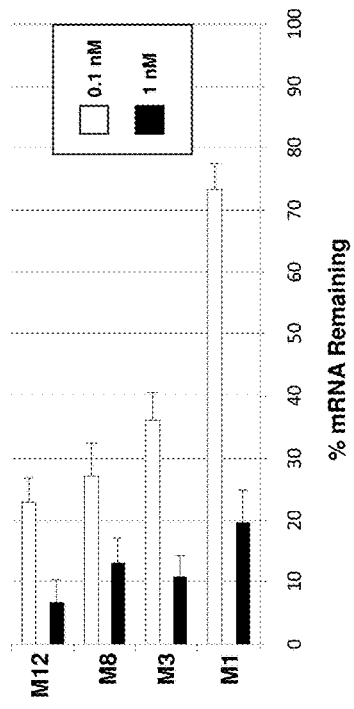
Figure 4:
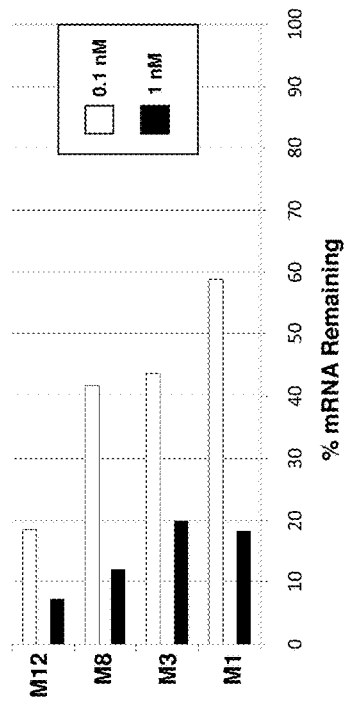
Figure 4:
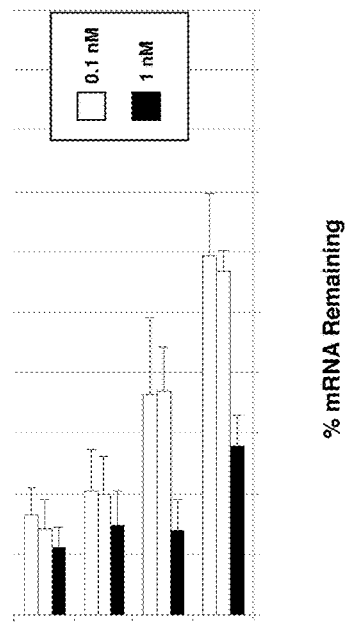

DsiRNA Inhibition of MET—Secondary Screen 96 asymmetric DsiRNAs of the above experiment were then examined in a secondary assay ("Phase 2"), with results of such assays presented in histogram form in FIGS. 3-1 to 3-4. Specifically, the 96 asymmetric DsiRNAs selected from the 432 tested above were assessed for inhibition of human MET at 1 nM and 0.1 nM (in duplicate assays) in the environment of human HeLa cells (FIGS. 3-1 and 3-2). These 96 asymmetric DsiRNAs were also assessed for inhibition of mouse MET at 1 nM and 0.1 nM (in duplicate assays) in the environment of mouse HEPA1-6 cells (FIGS. 3-3 and 3-4). As shown in FIGS. 3-1 and 3-2, a remarkable number of asymmetric DsiRNAs reproducibly exhibited robust human MET inhibitory efficacies at sub-nanomolar concentrations when assayed in the environment of HeLa cells. In addition, as shown in FIGS. 3-3 and 3-4, a number of these asymmetric DsiRNAs also showed robust mouse MET inhibitory efficacies at 1 nM and 100 pM when assayed in the environment of mouse HEPA1-6 cells. (Meanwhile, both human MET-specific and mouse MET-specific inhibitory asymmetric DsiRNAs were also identified.)

Example 4

Modified Forms of MET-Targeting DsiRNAs Reduce MET Levels In Vitro

24 MET-targeting DsiRNAs (MET-409, MET-590, MET-1036, MET-1040, MET-1362, MET-1961, MET-1982, MET-2856, MET-2882, MET-3158, MET-3488, MET-3512, MET-3576, MET-3827, MET-4011, MET-4320, MET-5265, MET-5313, MET-5548, MET-6127, MET-6600, MET-m1644, MET-m4653 and MET-m5259) were prepared with 2'-O-methyl guide strand modification patterns as shown in the schematic of FIG. 4-1. For each of the 24 DsiRNA sequences, DsiRNAs possessing each of the four guide strand modification patterns M12, M8, M3 and M1 were assayed for MET inhibition in human HeLa cells at 0.1 nM (in parallel assays) and 1.0 nM concentrations in the environment of the HeLa cells. Results of these experiments are presented as histograms in FIGS. 4-2 to 4-25. In general, the 24 DsiRNA sequences exhibited a trend towards reduced efficacy of MET inhibition as the extent of 2'-O-methyl modification of the guide strand increased. However, for almost all DsiRNA sequences examined, a modification pattern could be identified that allowed the DsiRNA to retain significant MET inhibitory efficacy in vitro. It was also notable that many DsiRNAs (e.g., MET-1982, MET-2856, MET-2882, MET-3158, MET-3488, MET-5265 and MET-5548) exhibited robust MET inhibitory efficacy in even the most highly modified states examined. These data confirm that it will likely be possible to identify effective DsiRNA sequences possessing sufficient levels of modification to stabilize such DsiRNAs and/or reduce immunogenicity of such DsiRNAs when therapeutically administered to a subject in vivo.

Example 5

Figure 5:
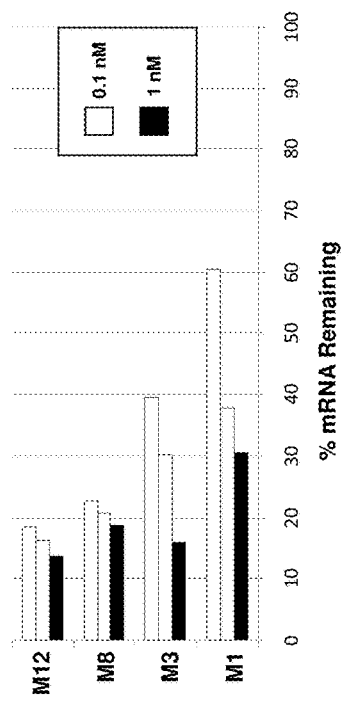

MET-Targeting Duplexes Possessing Modification Patterns of Both Strands Effectively Reduced MET mRNA Levels in Human Cells MET-targeting DsiRNAs that showed effective knockdown of MET mRNA when possessing modified guide strands were further modified upon the passenger strand, and these new modified DsiRNAs were assessed for MET reducing activity in human HeLa cells. Passenger strand modification patterns that were employed in this Example are shown in FIG. 5-1, while duplex modification patterns used are shown in FIGS. 5-2 and 5-3 (it is noted that the passenger strand modification pattern is listed first, with the guide strand modification pattern listed second, e.g., the "M0-M3" duplex modification pattern corresponds to a passenger strand possessing the M0 (or "SM0") passenger strand modification pattern and a guide strand possessing the M3 (or "AS-M3") guide strand modification pattern). 24 MET-targeting DsiRNAs (MET-586, MET-1040, MET-1042, MET-1362, MET-1474, MET-1961, MET-1982, MET-2790, MET-2856, MET-2879, MET-2882, MET-3276, MET-3488, MET-3492, MET-3582, MET-3780, MET-3922, MET-3935, MET-4011, MET-5265, MET-5357, MET-5548, MET-5847 and MET-6600) were assayed for MET inhibition at 0.1 nM (in parallel assays) and 1.0 nM concentrations in the environment of the HeLa cells. Results of these experiments are presented as histograms in FIGS. 5-4 to 5-7. In general, the 24 DsiRNA sequences possessing modifications of both strands exhibited a trend towards reduced efficacy of MET inhibition as the total extent of 2'-O-methyl modification increased. However, for almost all DsiRNA sequences examined, an extensively modified duplex could be identified that allowed the DsiRNA to retain significant MET inhibitory efficacy in vitro. It was also notable that many DsiRNAs (e.g., MET-586, MET-1040, MET-1042, MET-1982, MET-2882, MET-3488, MET-3492, MET-3582, MET-3780, MET-3922, MET-3935, MET-5265, MET-5357, MET-5548, MET-5847 and MET-6600) exhibited robust MET inhibitory efficacy in even the most highly modified states examined. These data further confirmed the ability to identify effective DsiRNA sequences possessing significant levels of modification, which should stabilize such DsiRNAs and/or reduce immunogenicity of such DsiRNAs when therapeutically administered to a subject in vivo.

Example 6

Figures 4, 5, 6, 7, 8, 9, 10, 11:
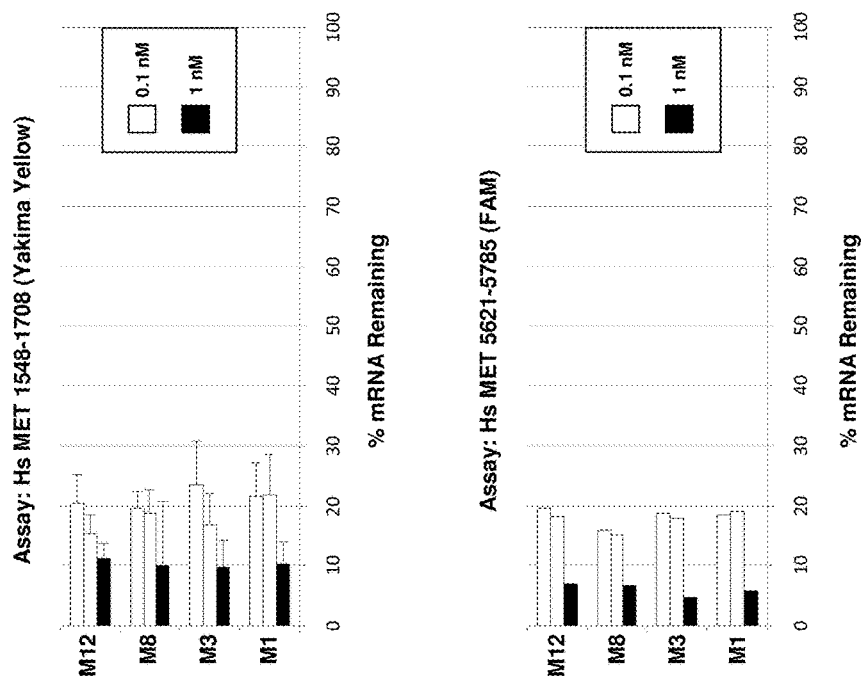

Dose-Response of Selected MET-Targeting DsiRNAs $IC_{50}$ values associated with MET knockdown in HeLa cells were obtained for the following MET-targeting DsiRNAs: MET-2113, MET-4559, MET-4947, MET-5094, MET-5357, MET-5946, MET-6307 and MET-6520 (FIG. 6), as well as MET-1040-M12, MET-1042-M37, MET-2864-M37, MET-2882-M12, MET-3158-M1, MET-3158-M12, MET-3488-M1 and MET-3488-M12 (FIG. 7). Assays were performed at 24 hours post-transfection, with duplexes possessing a varying number of 2'-O-Methyl modified guide strand residues. In all but one instance, observed $IC_{50}$ values were below 100 pM (and in many instances were below 10 pM). Thus, MET-targeting DsiRNAs were further demonstrated to be remarkably potent and effective inhibitors of MET expression.

While $IC_{50}$ values in general tended to increase as the extent of modification of a given DsiRNA guide strand sequence increased, the MET-2864 duplex surprisingly exhibited enhanced potency (as indicated by a lower $IC_{50}$ value) when presenting the "M37" guide strand modification pattern, as compared to duplexes presenting "M39", "M5", "M12" and "M8" guide strand modification patterns (FIG. 8). MET mRNA knockdown assays were performed at 24 hours post-transfection in HeLa cells, and a relatively highly modified duplex ("M37") showed the lowest measured $IC_{50}$ value (20.35 pM; FIG. 8). Thus, for certain duplex sequences and modification patterns, a modification pattern that possesses an increased number of modified residues can actually enhance target knockdown.

Example 7

MET-Targeting DsiRNAs Reduced c-Met Protein Levels In Vitro

In vitro cell line and in vivo mouse levels of c-Met protein were initially examined by western blot, with results presented in FIG. 9. Notably, HeLa, Hep3B, Huh7 cell lines and mouse spleen and lung cells were observed to express the highest levels of c-Met protein, when normalized to Tubulin.

The impact of MET-targeting DsiRNAs upon cellular Met protein levels was then examined in vitro. As shown in FIG. 10, MET mRNA and encoded c-Met protein knockdown levels were directly correlated. Specifically, MET mRNA knockdown $IC_{50}$ dose-response curves were obtained for MET-4559, MET-5094 and MET-5357 DsiRNAs in HeLa cells harvested at 24 hours post-DsiRNA administration, obtaining respective $IC_{50}$ values of 7.6 pM, 107 pM and 10.1 pM. Levels of c-Met protein in human HeLa cells treated with these three MET-targeting DsiRNAs were assessed via western blot, and relative levels of c-Met knockdown were observed to vary between the tested DsiRNAs in a manner that reflected the variation observed in $IC_{50}$ mRNA knockdown values (FIG. 10, bottom panels). Notably, the strongest levels of both MET mRNA and c-Met knockdown were observed for MET-4559 and MET-5357 (FIG. 10).

Figures 4, 5, 6, 7, 8, 9, 10, 11, 12, 13, 14, 15, 16, 17, 18, 19, 20, 21, 22, 23, 24, 25, 26:
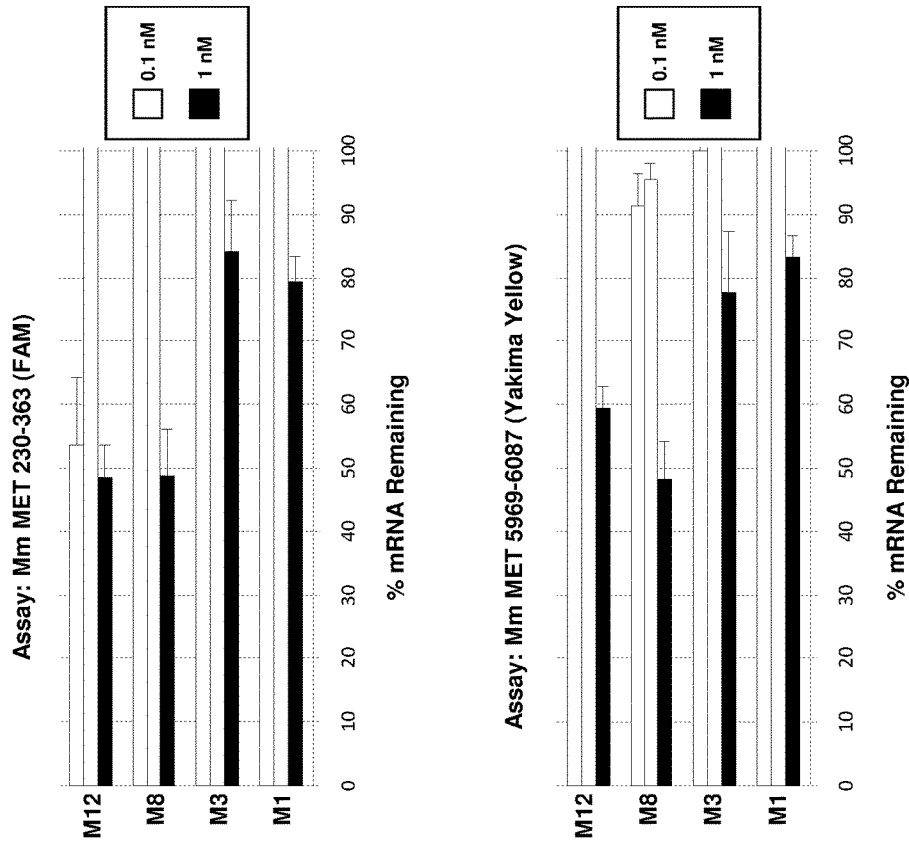
Figures 4, 5, 6, 7, 8, 9, 10, 11, 12, 13, 14, 15, 16, 17, 18, 19, 20, 21, 22, 23, 24, 25, 26, 27, 28:
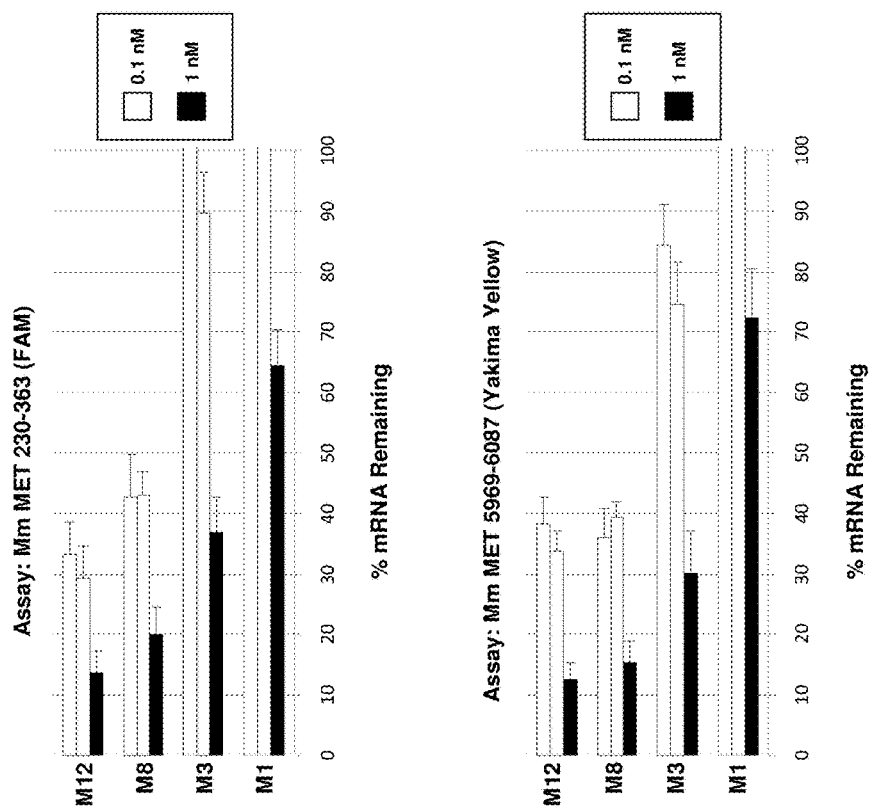
Figures 4, 5, 6, 7, 8, 9, 10, 11, 12, 13, 14, 15, 16, 17, 18, 19, 20, 21, 22, 23, 24, 25, 26, 27, 28, 29:
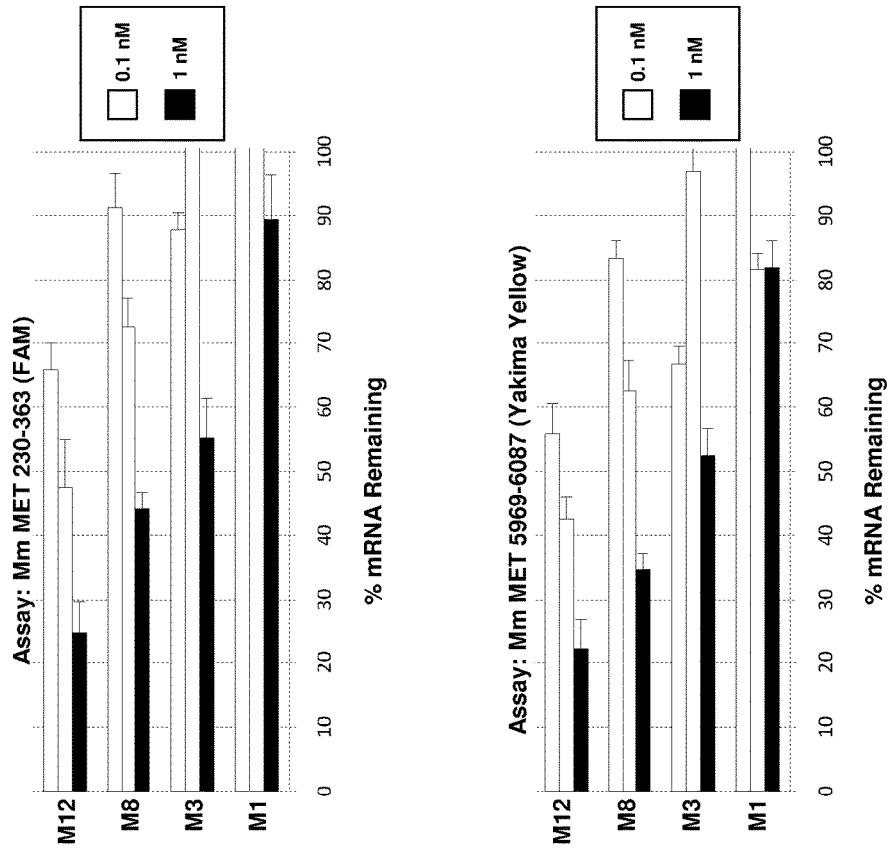
Figures 4, 5, 6, 7, 8, 9, 10, 11, 12, 13, 14, 15, 16, 17, 18, 19, 20, 21, 22, 23, 24, 25, 26, 27, 28, 29, 30:
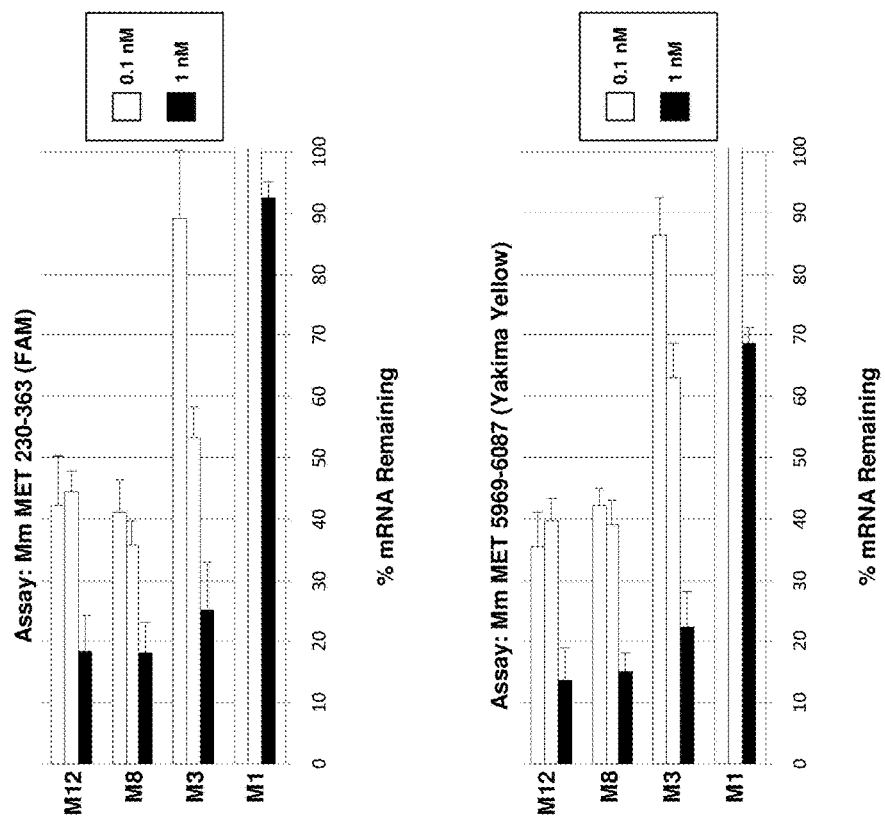
Figures 4, 5, 6, 7, 8, 9, 10, 11, 12, 13, 14, 15, 16, 17, 18, 19, 20, 21, 22, 23, 24, 25, 26, 27, 28, 29, 30, 31:
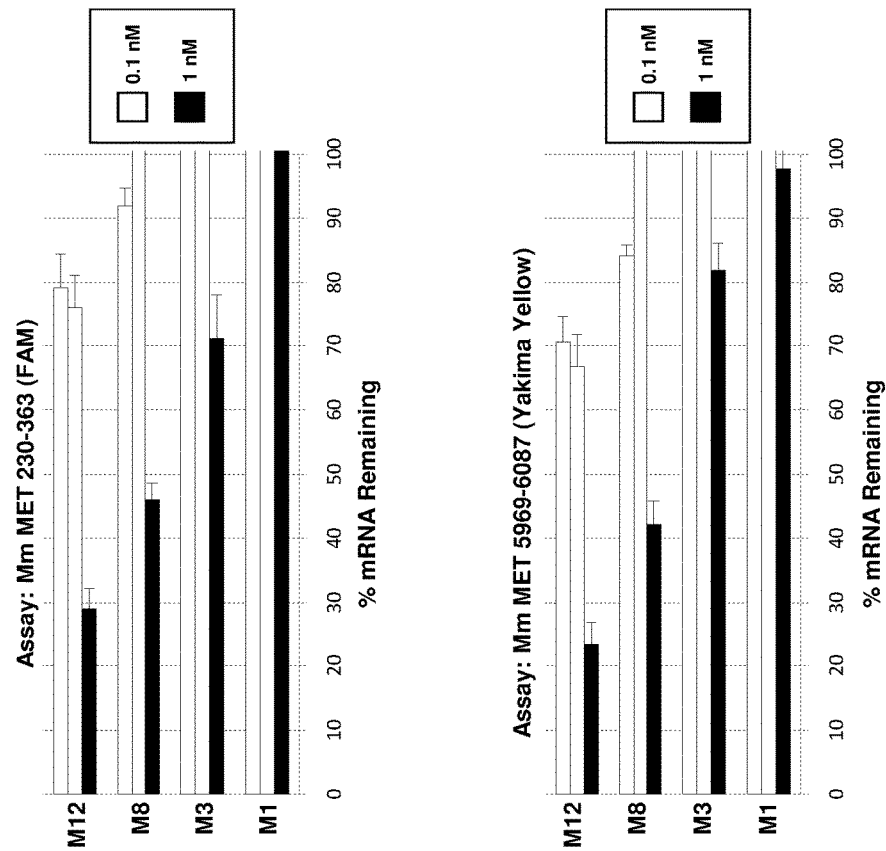
Figures 4, 5, 6, 7, 8, 9, 10, 11, 12, 13, 14, 15, 16, 17, 18, 19, 20, 21, 22, 23, 24, 25, 26, 27, 28, 29, 30, 31, 32, 33:
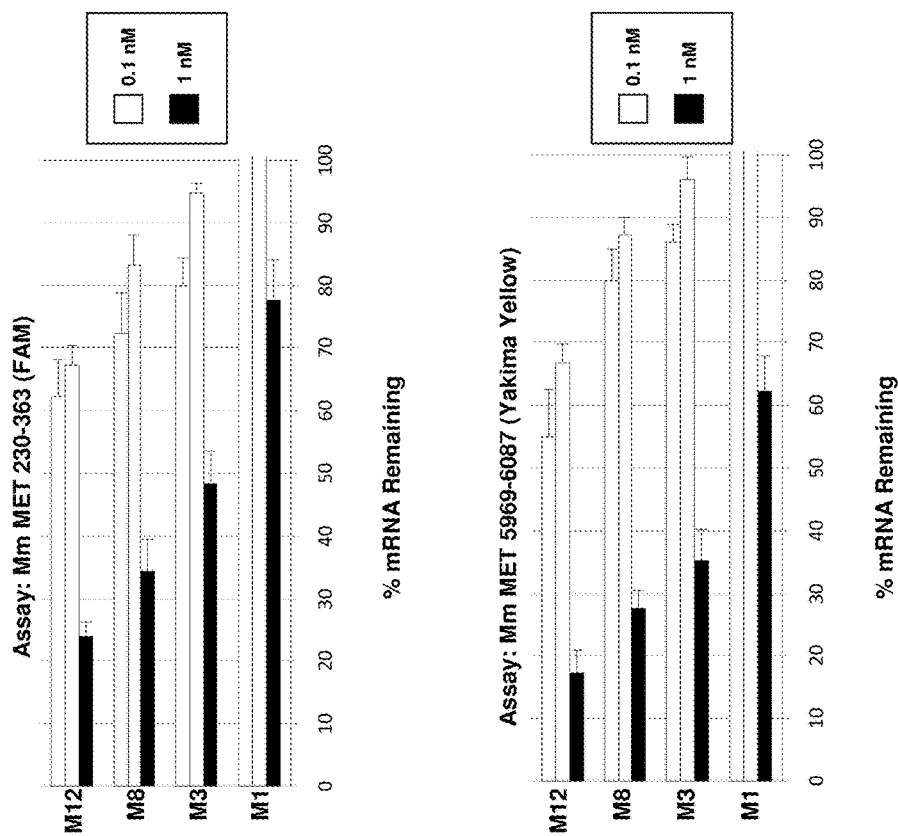
Figures 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34:
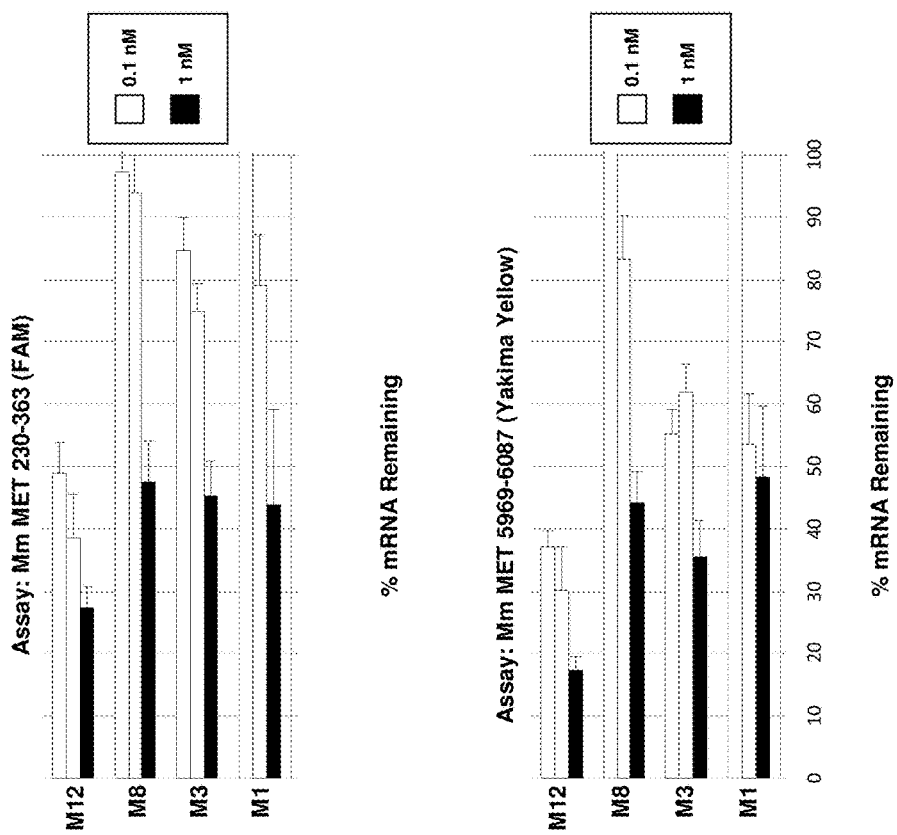
Figures 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35:
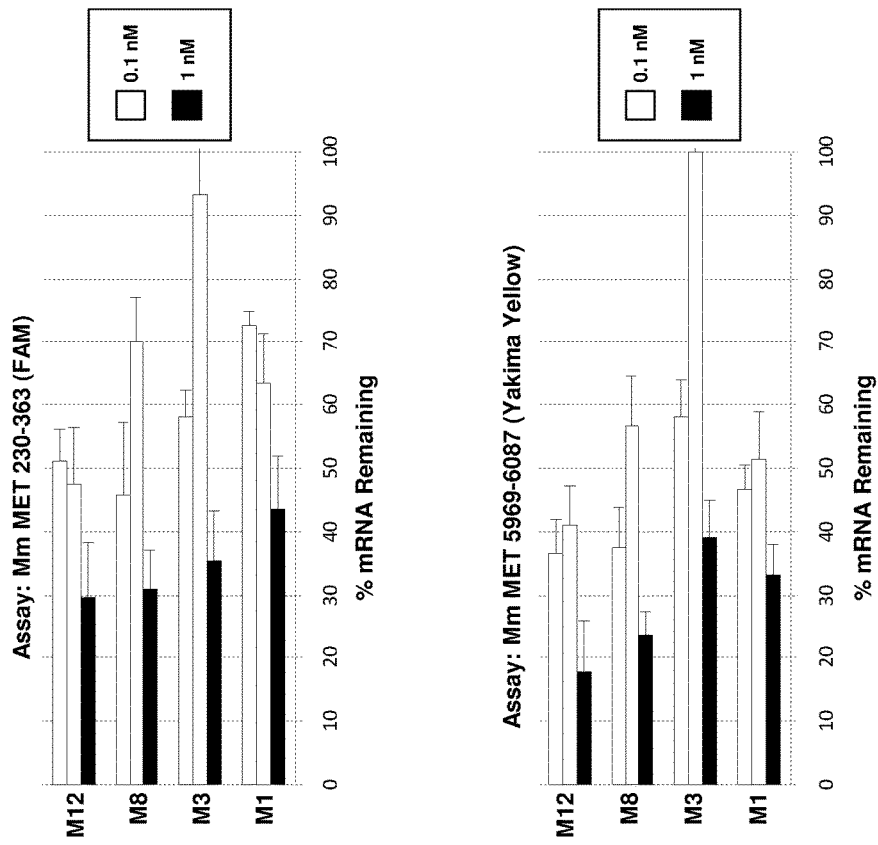
Figures 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36:
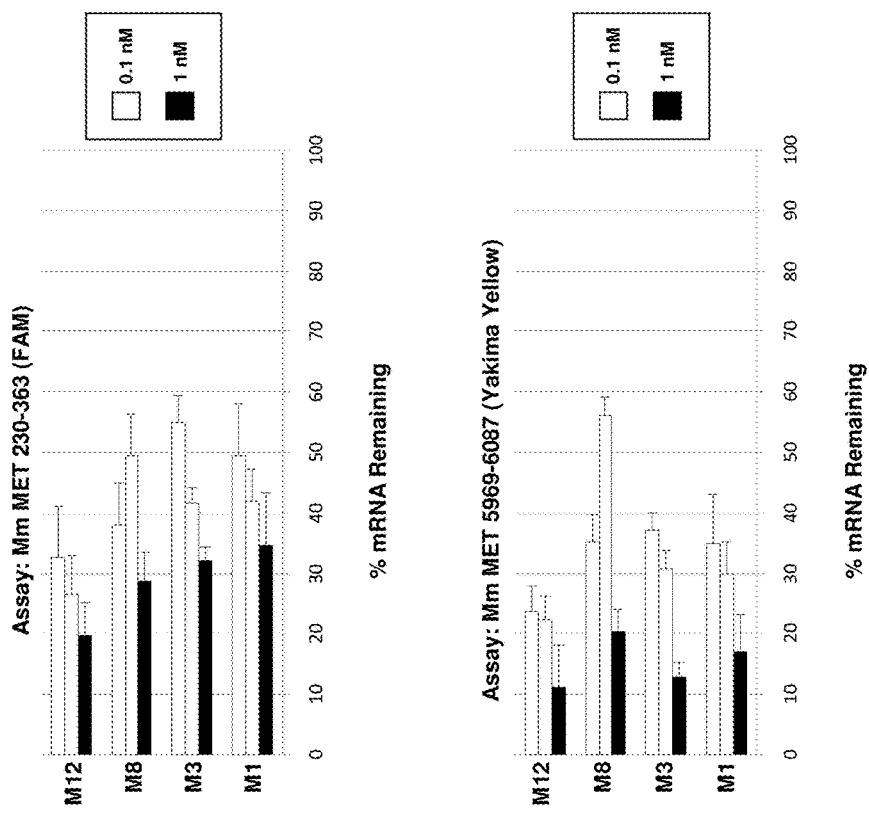
Figures 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37:
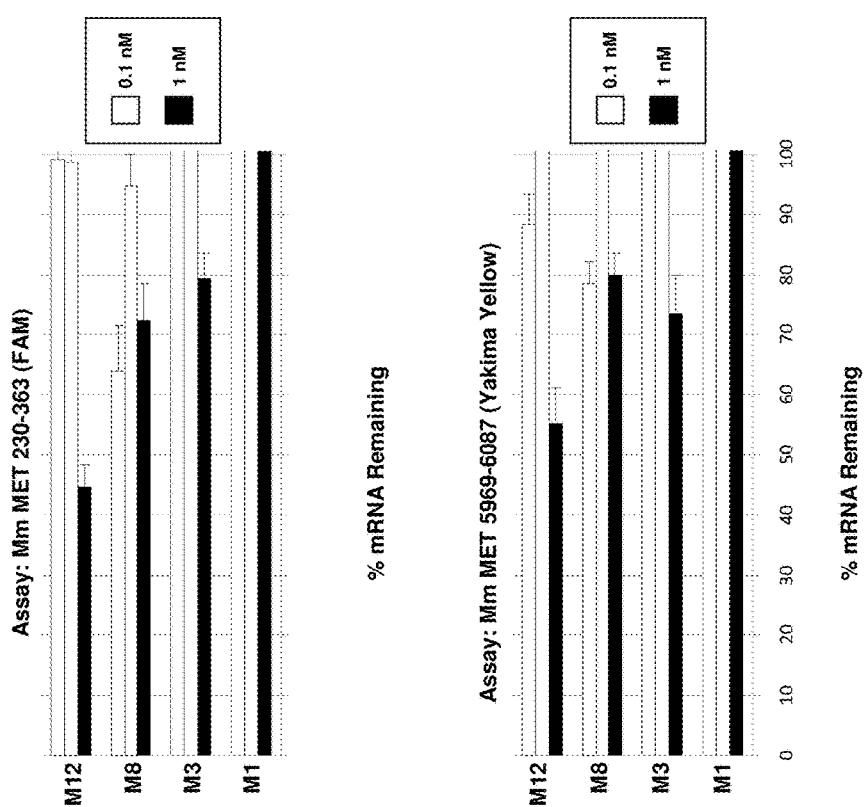
Figures 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38:
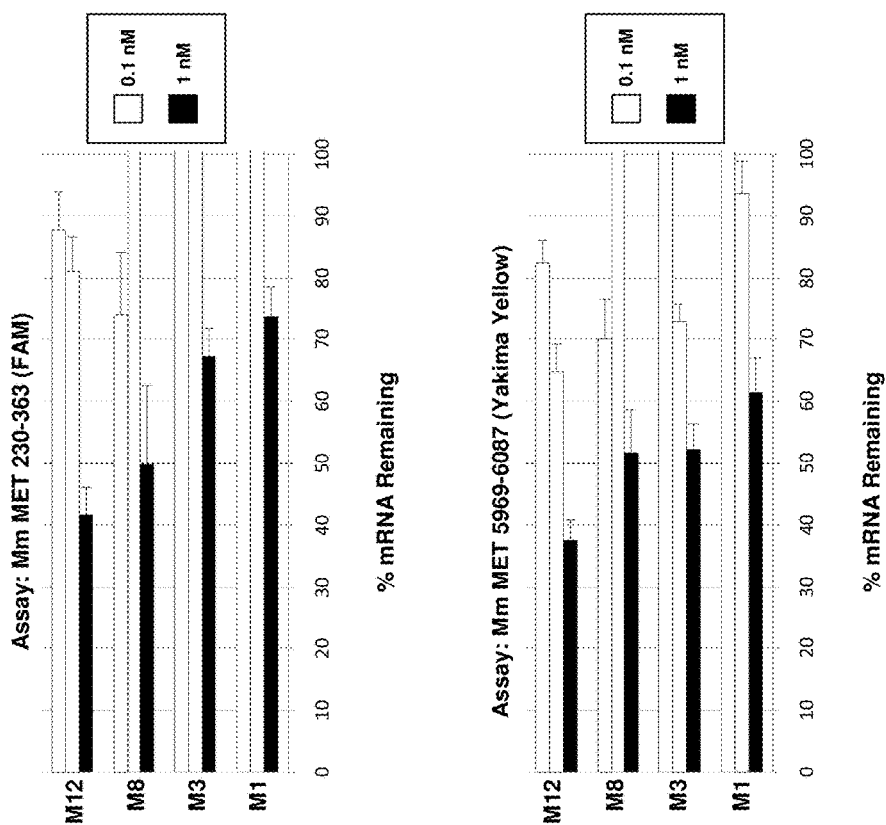
Figures 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39:
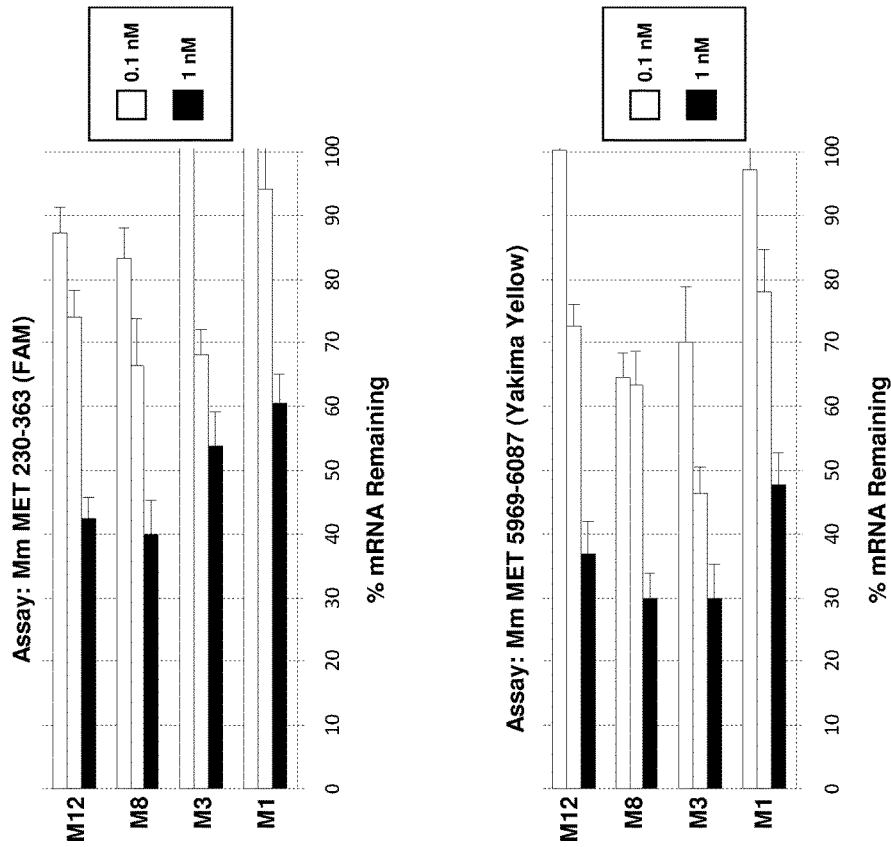
Figures 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41:
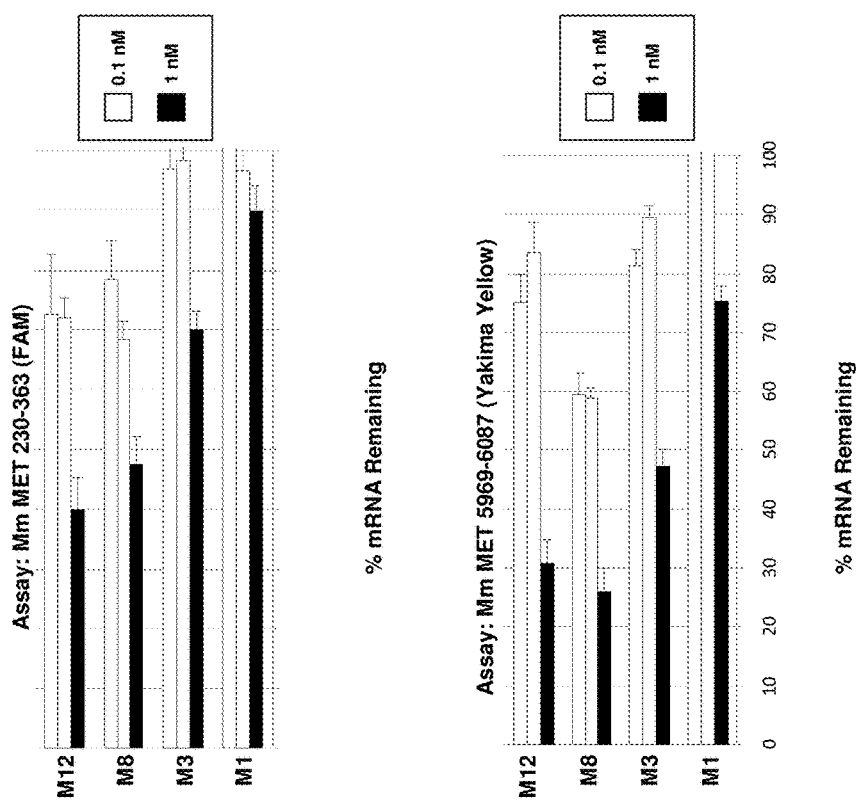
Figures 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42:
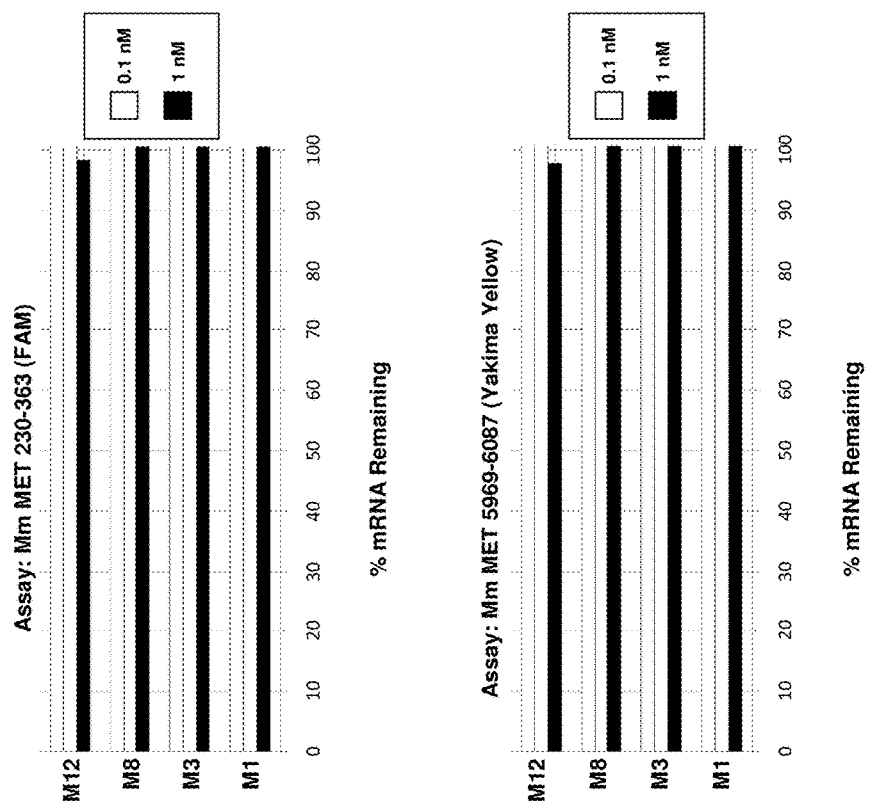
Figures 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44:
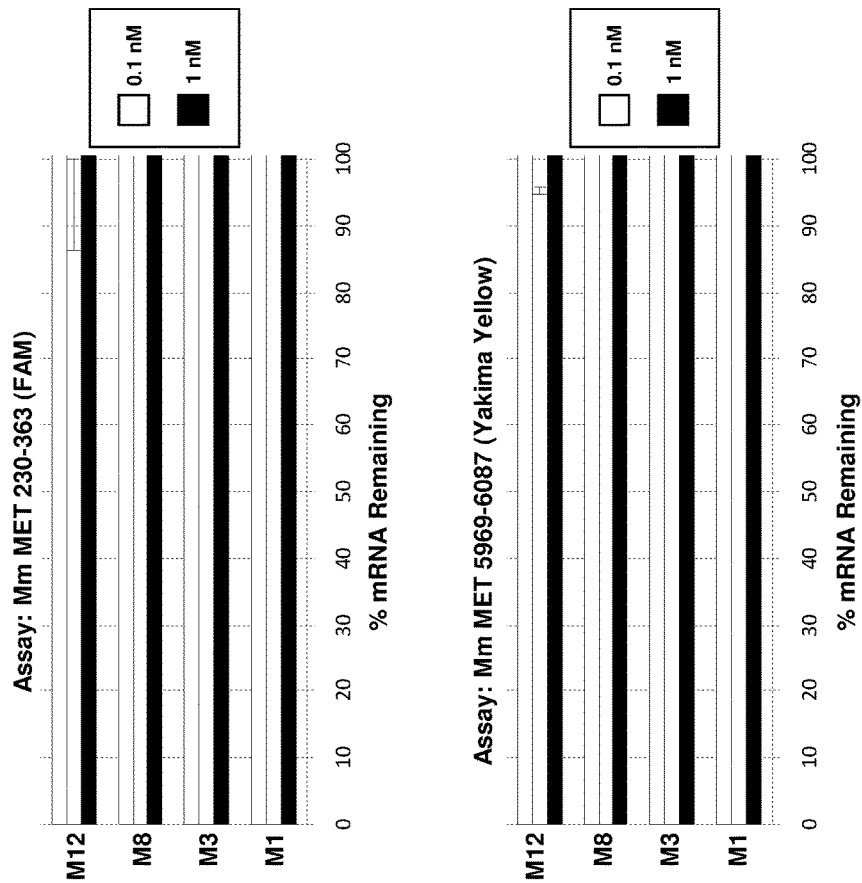
Figures 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46:
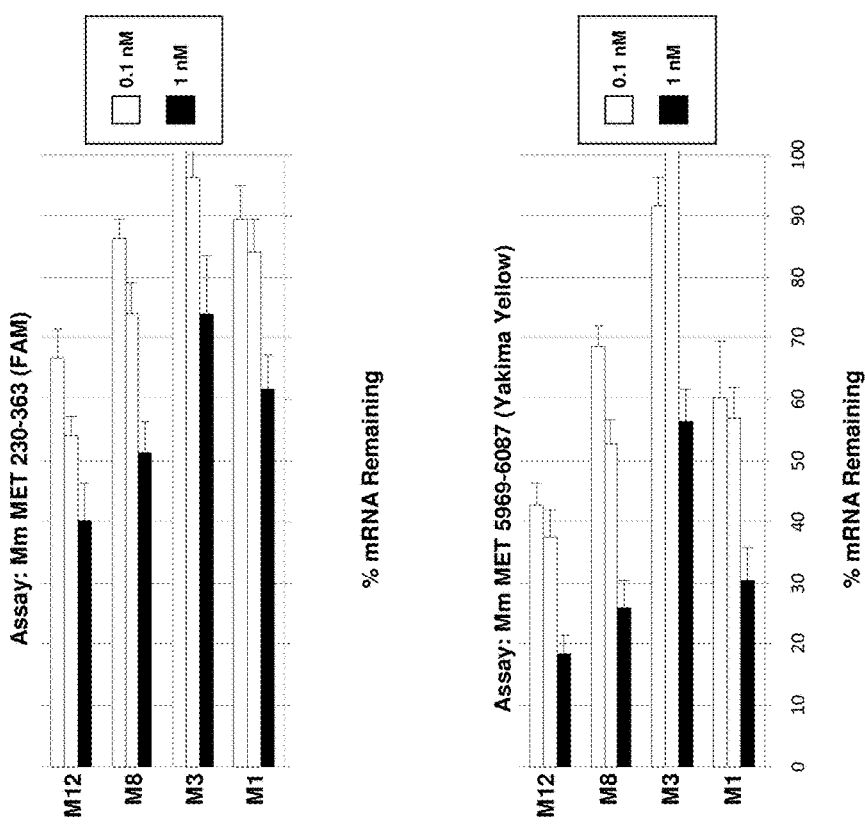
Figures 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48:
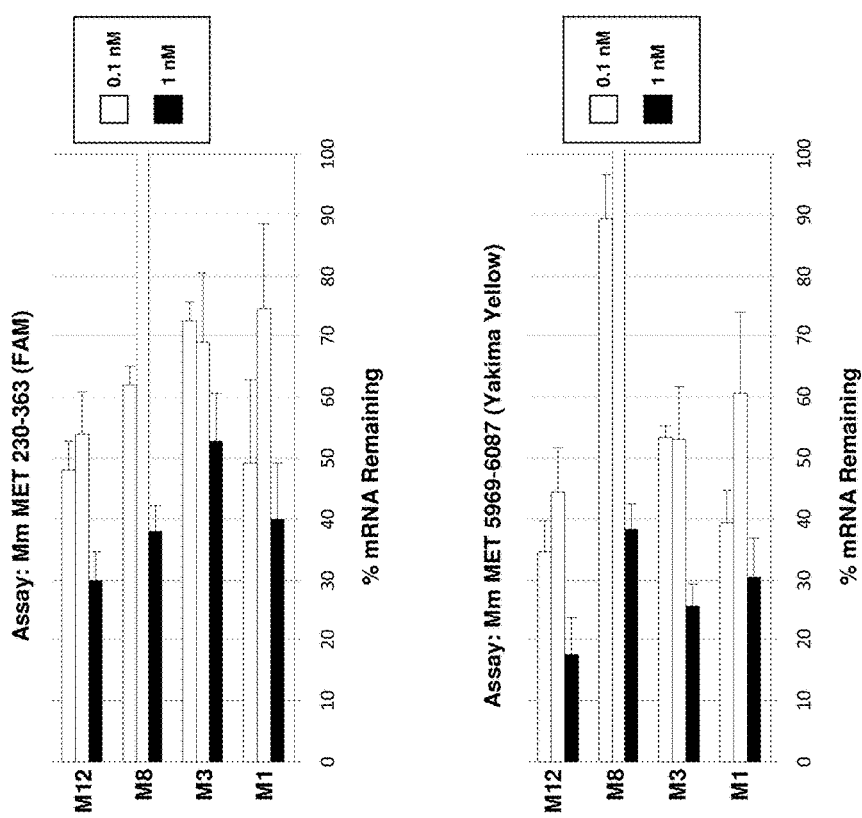
Figures 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49:
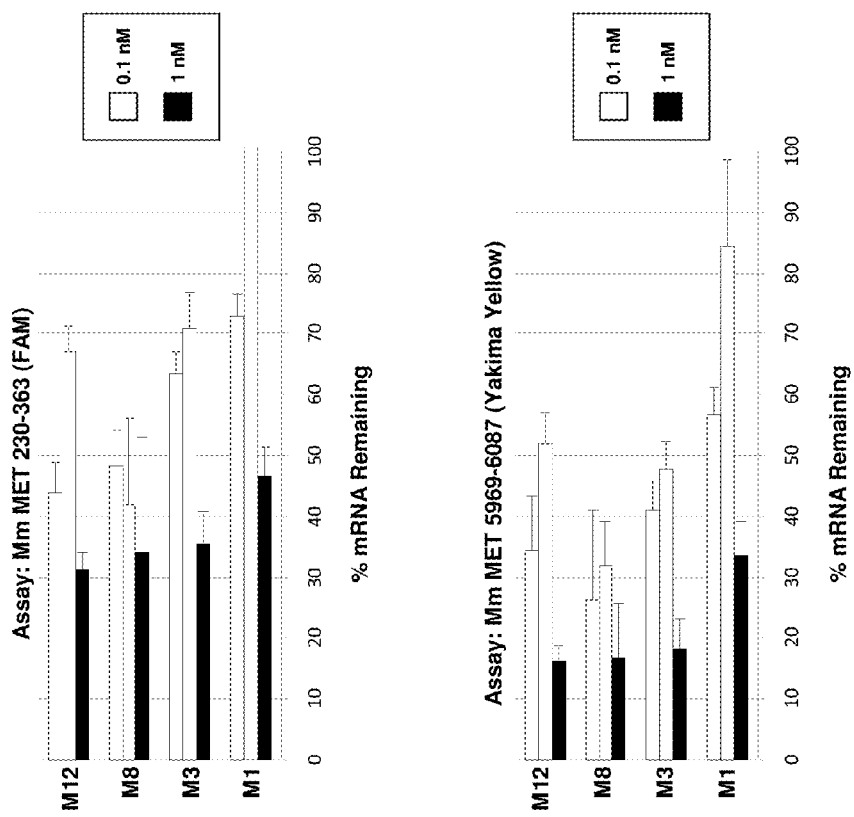
Figures 1, 5:
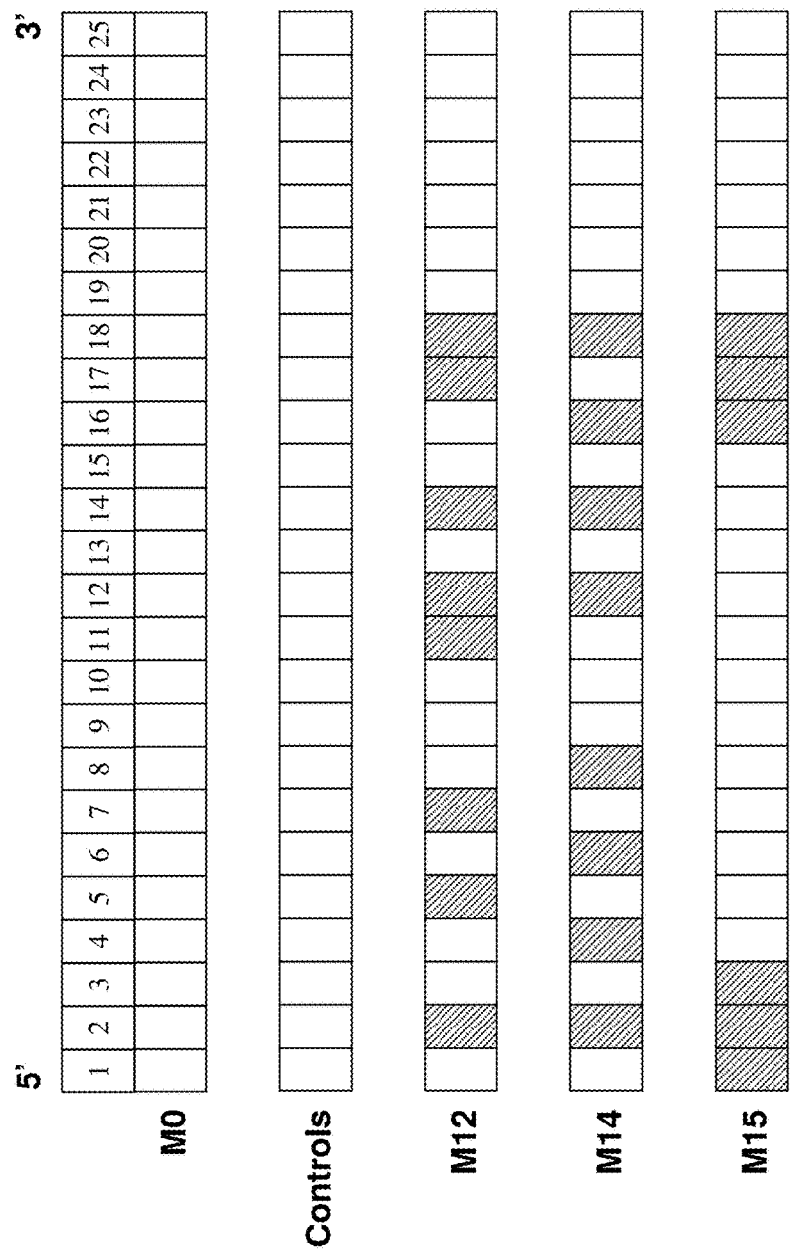
Figures 2, 5:
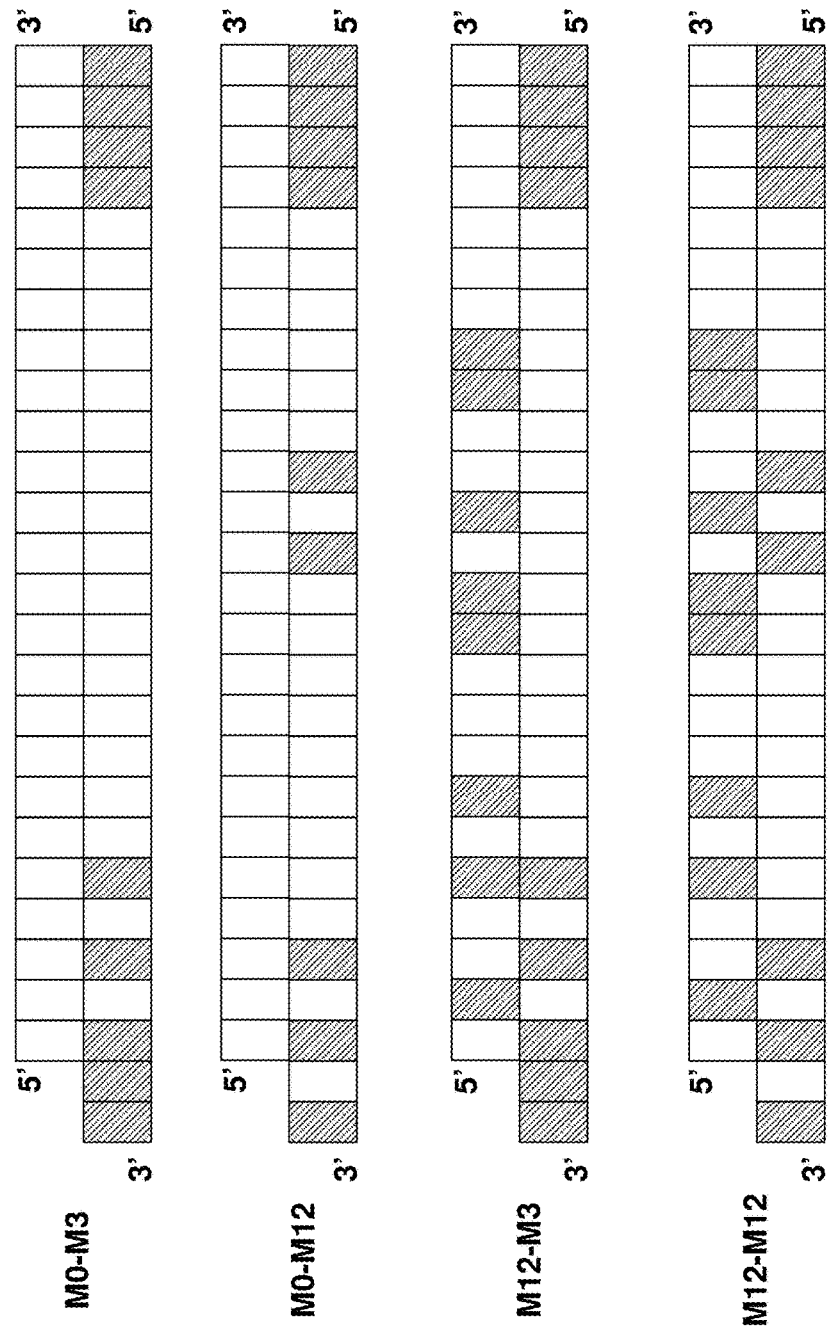
Figures 3, 5:
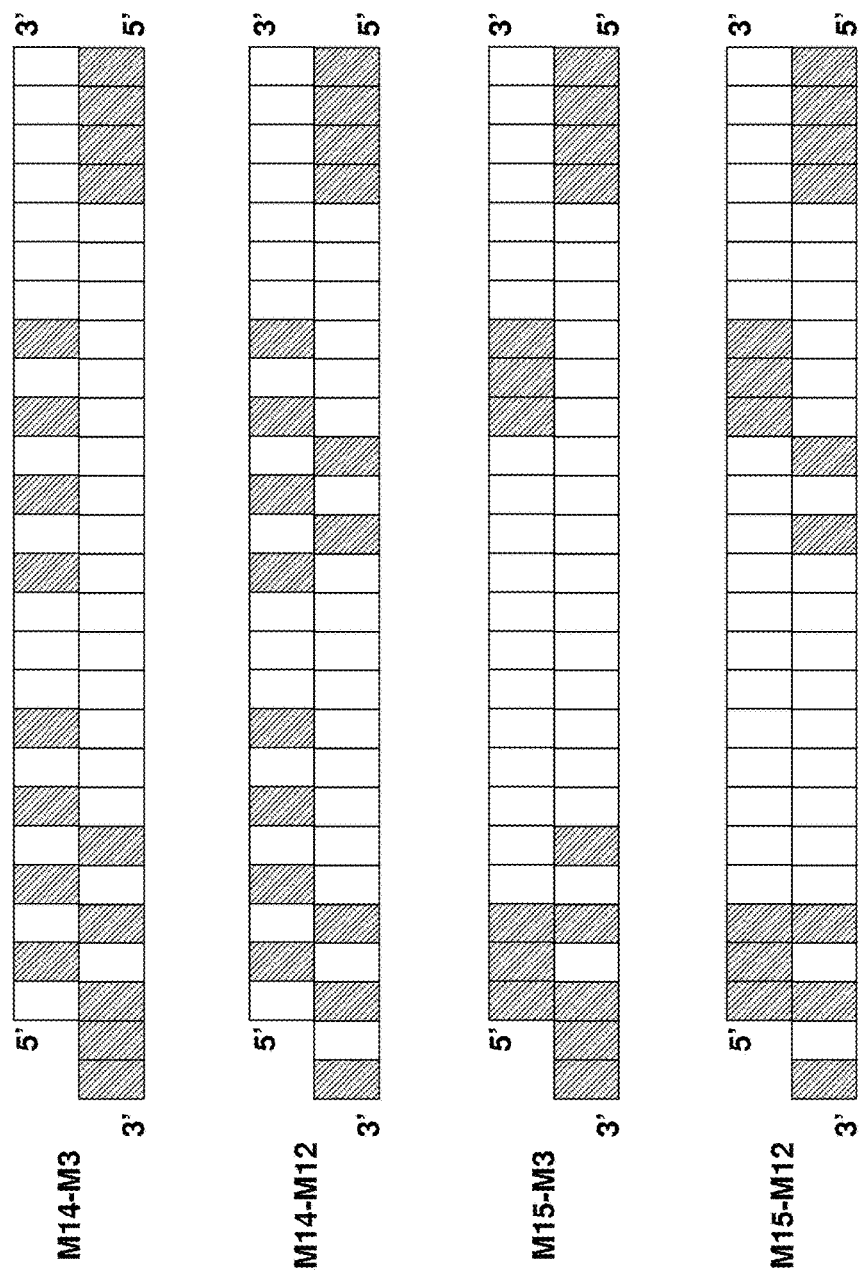
Figure 6:
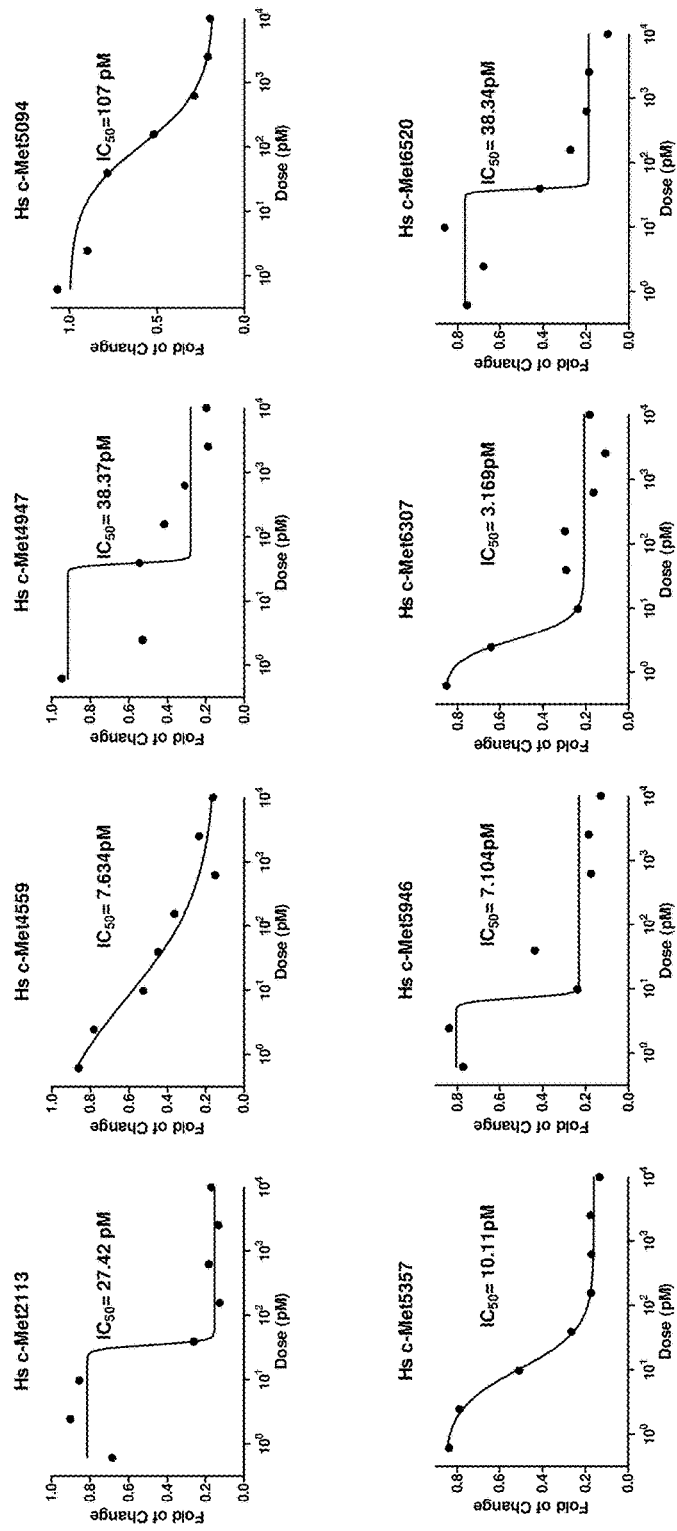
Figure 7:
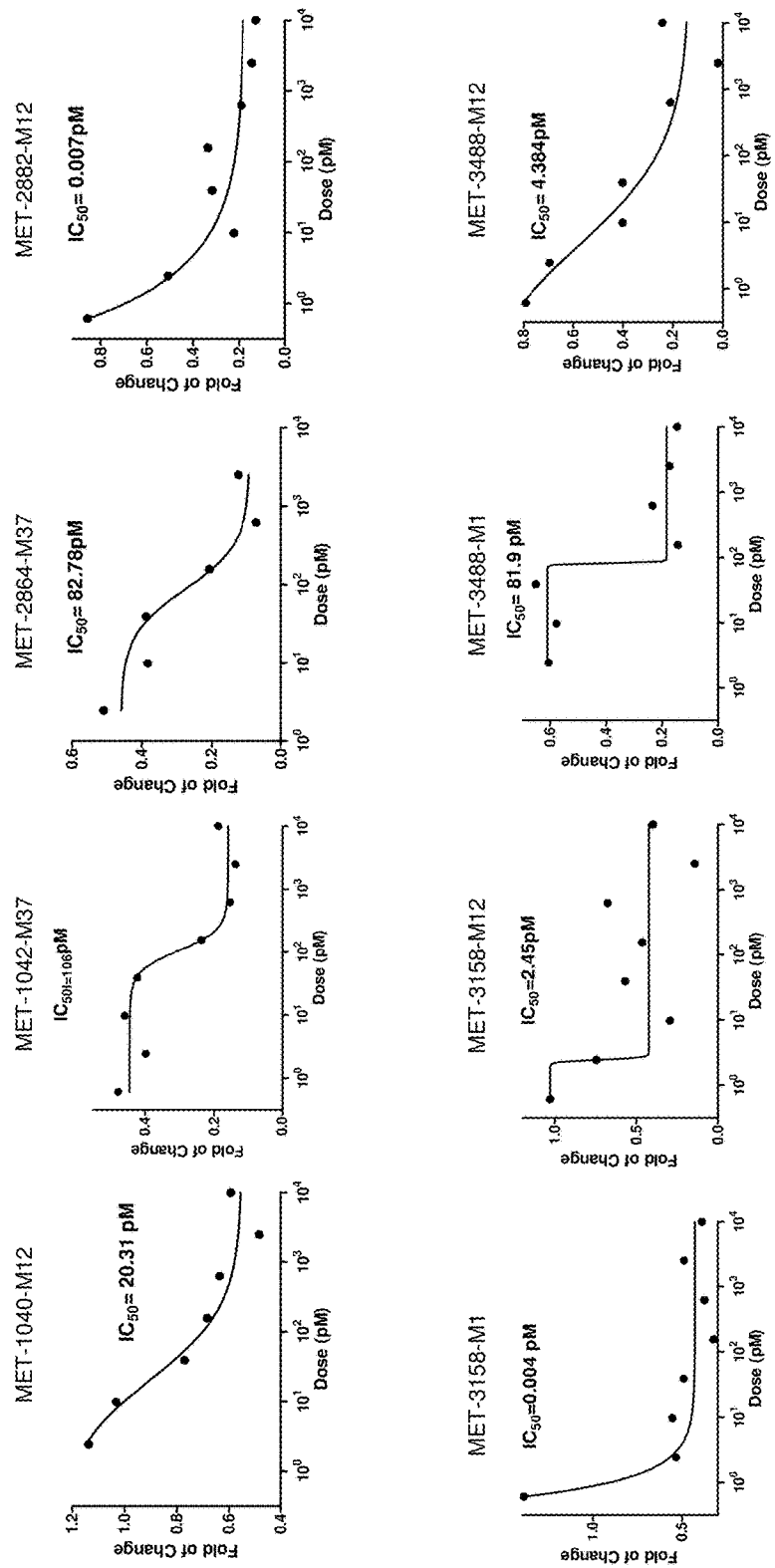
Figure 8:
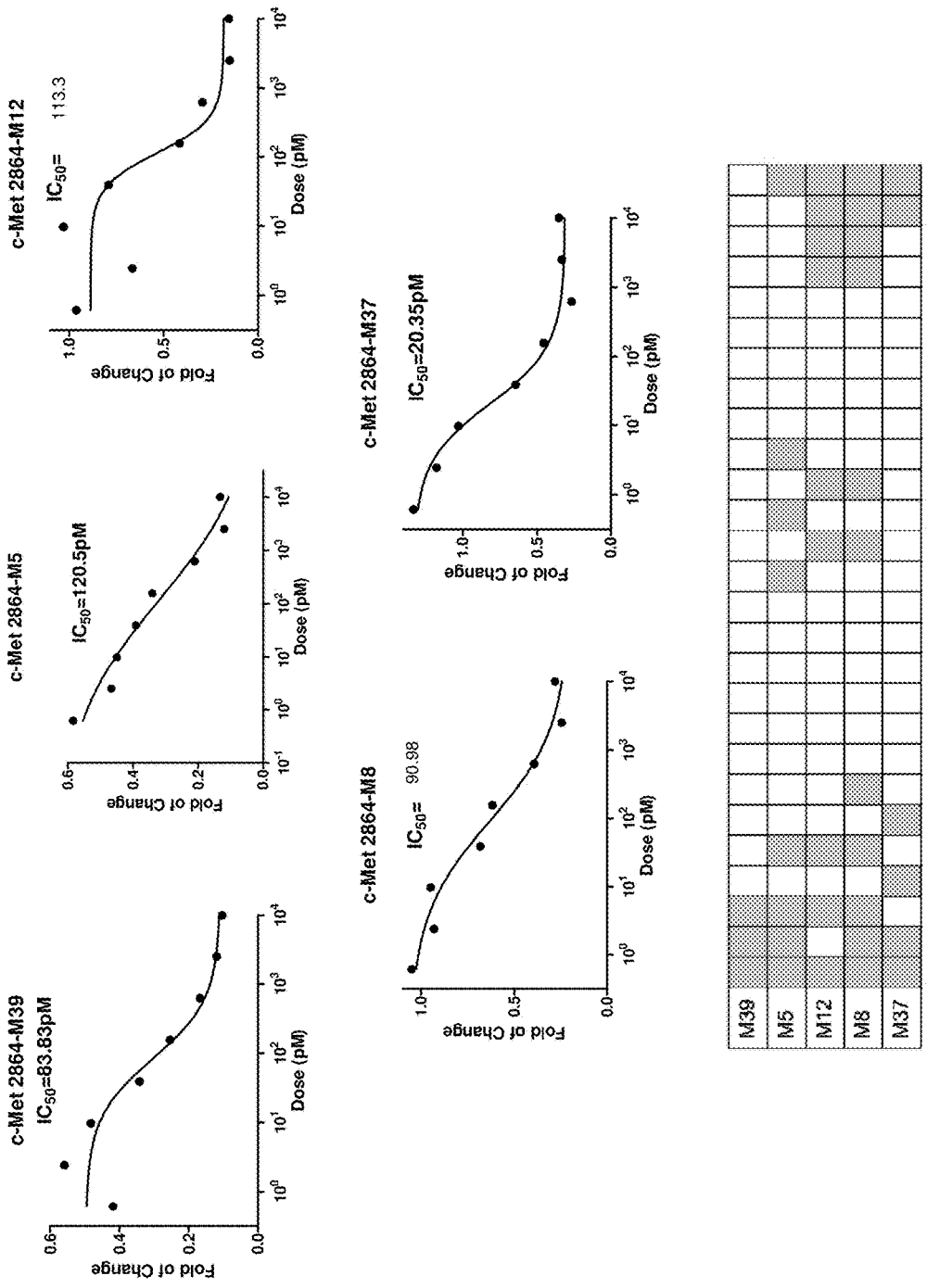
Figure 9:
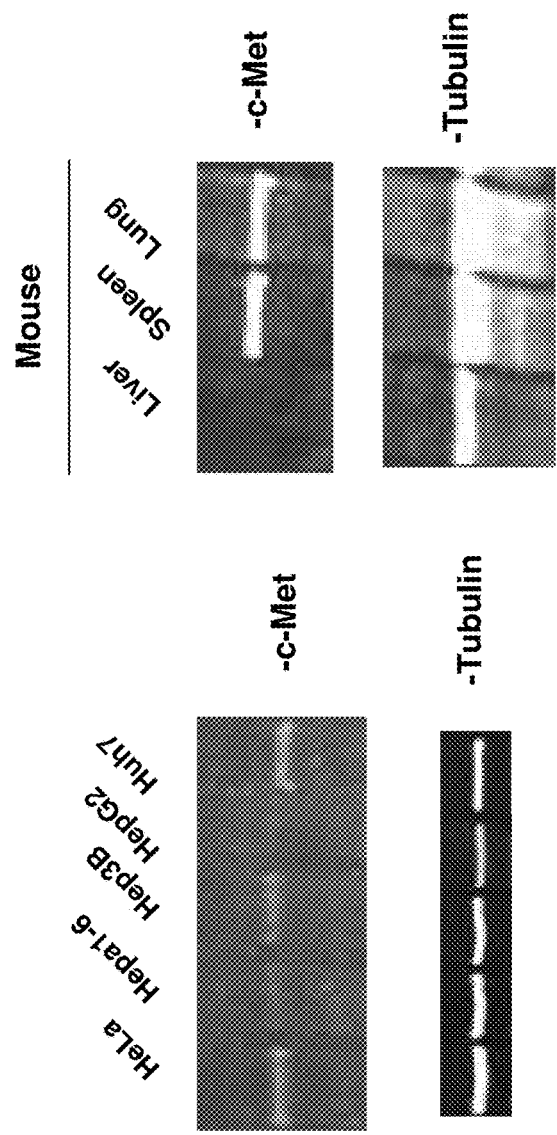
Figure 10:
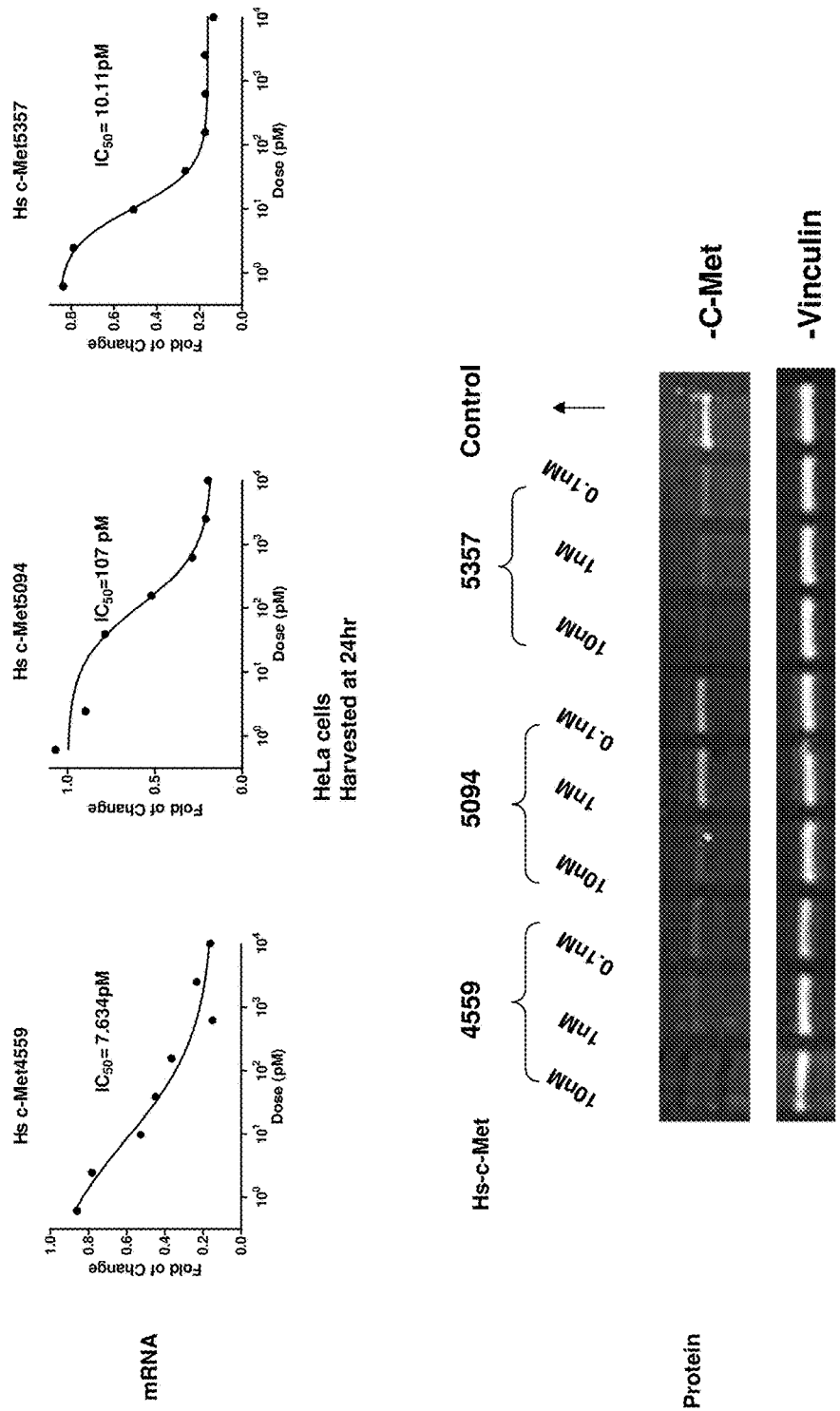
Figure 11:
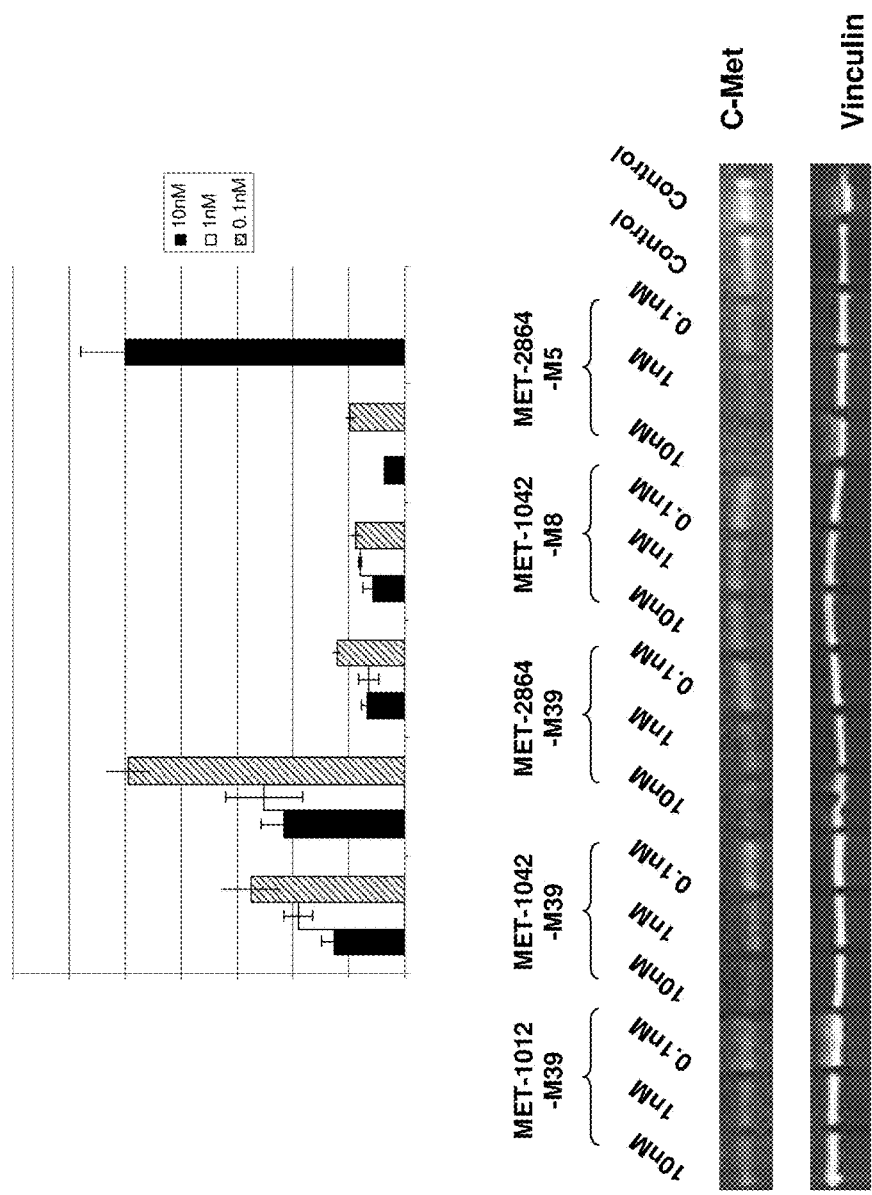
Figure 12:
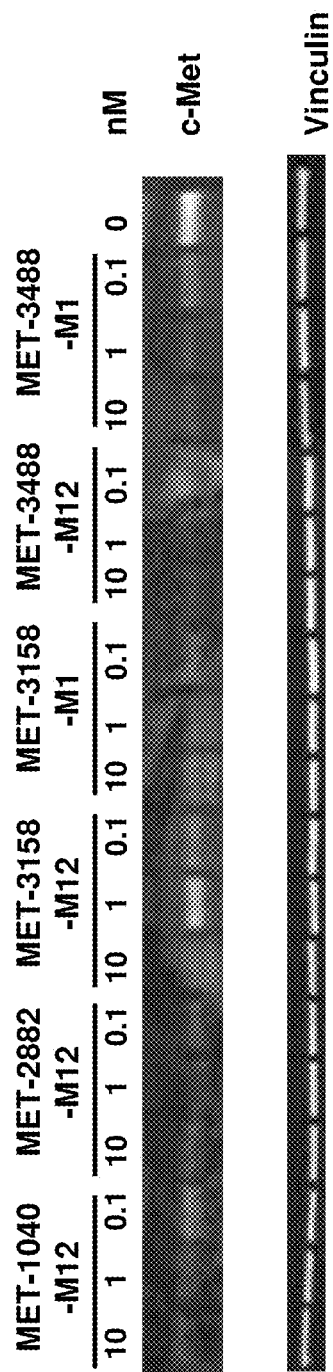
Figure 13:
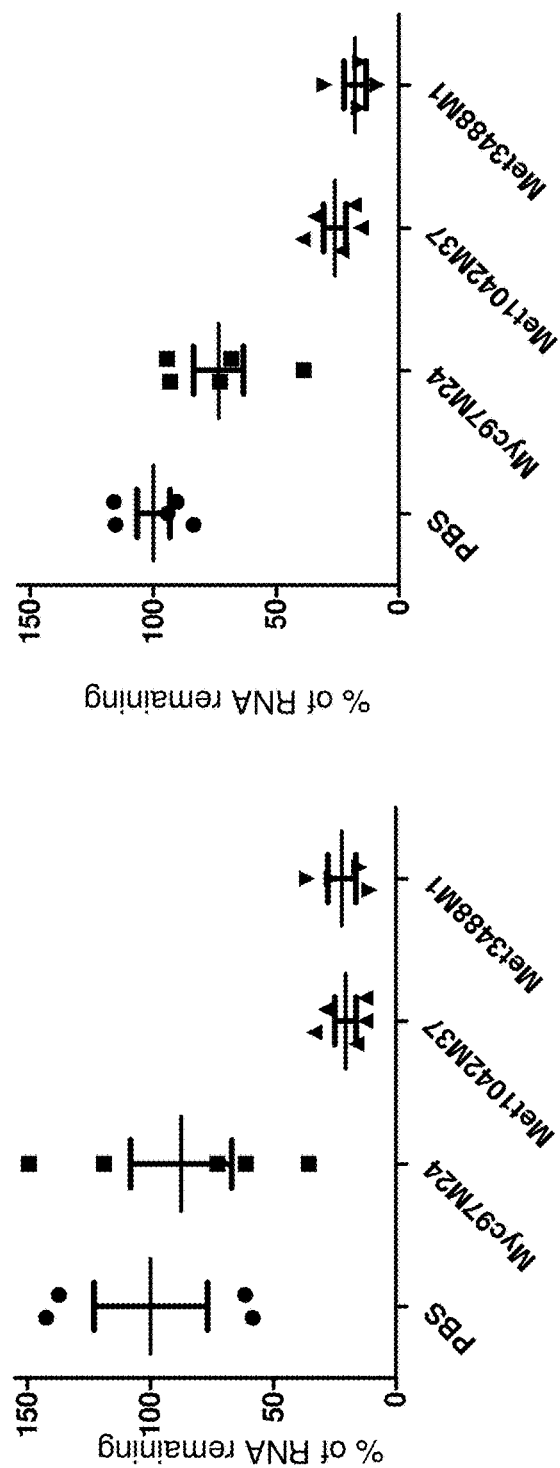
Figure 14:
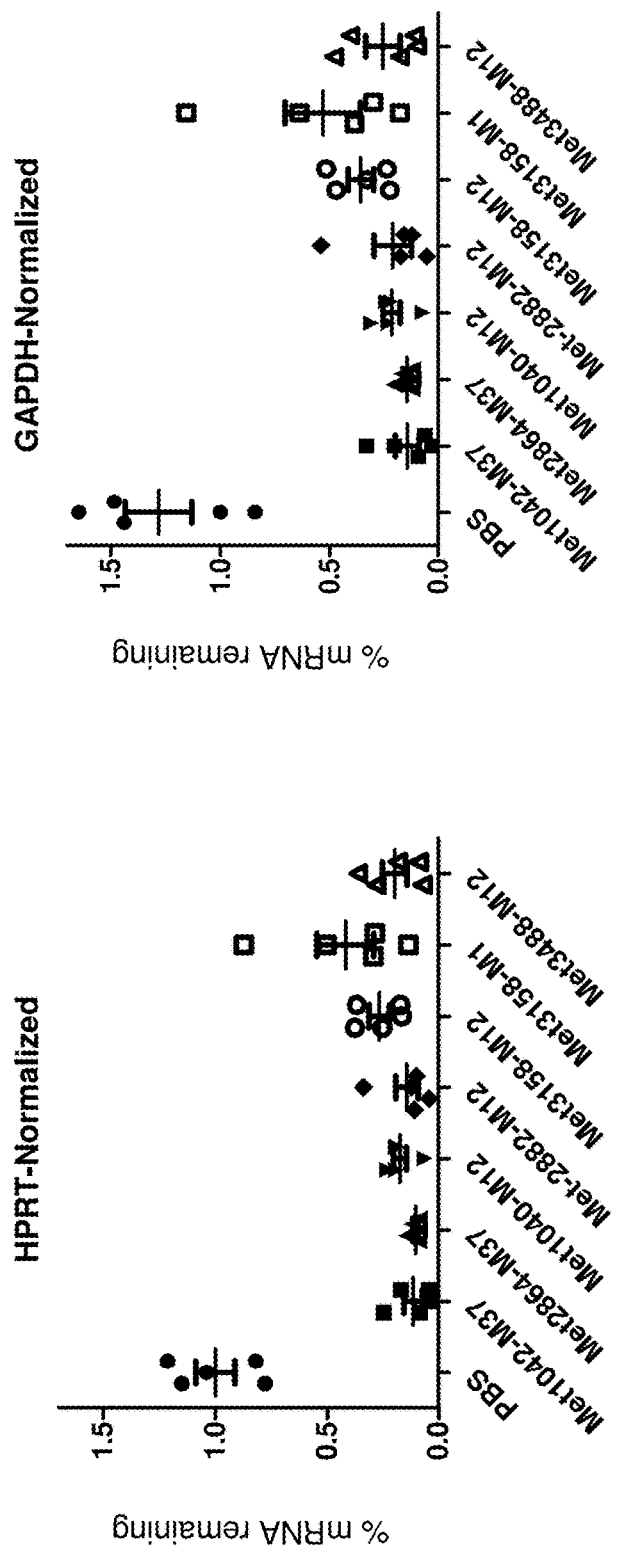

The extent of c-Met protein knockdown observed for MET-targeting DsiRNAs possessing various guide strand 2'-O-methyl modification patterns was also examined, and MET mRNA levels in treated HeLa cells were again observed to correlate directly with c-Met levels in treated HeLa cells. As shown in FIG. 11, MET mRNA knockdown levels were observed for HeLa cells treated with MET-1012-M39, MET-1042-M39, MET-2864-M39, MET-1042-M8 and MET-2864-M5 DsiRNAs, as assayed at 24 hours post-transfection. Western blot results for c-Met and Vinculin (control protein) in HeLa cells treated with these MET-targeting DsiRNAs were also obtained, with cells harvested at 48 hours post-DsiRNA administration at 10 nM, 1 nM or 0.1 nM (initially transfected at t=0 and re-transfected at t=24 hours). Specifically, on day 2 post-administration, HeLa cells were harvested and nuclear proteins were isolated for western blot analysis (via use of a NE-PER™ Nuclear and Cytoplasmic Extraction Reagents kit from Thermo-Fisher Scientific™, Cat # P178833)). The Western blot of FIG. 11 was probed with anti-MET antibody and with anti-Vinculin antibody to determine protein levels. Notably, the MET mRNA knockdown demonstrated for the MET-1012-M39, MET-1042-M39, MET-2864-M39, MET-1042-M8 and MET-2864-M5 DsiRNAs was shown to correlate directly with the significant knockdown of c-Met protein levels that was observed for these DsiRNAs.

c-Met protein knockdown was also observed for MET-targeting DsiRNAs MET-1040-M12, MET-2882-M12, MET-3158-M12, MET-3158-M1, MET-3488-M12 and MET-3488-M1 in treated HeLa cells (FIG. 12).

Example 8

In Vivo Efficacy of MET-Targeting DsiRNAs

To test the activity of a DsiRNA directed against MET in vivo, CD1 mice were administered the MET-targeting DsiRNAs MET-1042-M37 and MET-3488-M1. Mice were treated by i.v. tail vein injection with either PBS (control vehicle), a control DsiRNA (MYC-97-M24), or MET-targeting DsiRNAs MET-1042-M37 or MET-3488-M1. DsiRNAs were formulated in Invivofectamine® 2.0 (InVitrogen), and were administered at a dose of 10 mg/kg body weight (administered at time 0). Three days after administration, animals were sacrificed and tissues of interest (e.g., lung, liver, spleen, kidney, colon, etc.) were harvested. Results obtained for mouse liver tissue assays are shown in FIG. 13, where both MET-1042-M37 and MET-3488-M1 DisRNAs significantly reduced MET mRNA levels in vivo, by greater than 70% at 72 hours after DsiRNA dosing. The left-hand and right-hand panels of FIG. 13 reflect the results obtained in using two distinct probes for MET mRNA.

In vivo knockdown results were also obtained for MET-targeting DsiRNAs MET-1042-M37, MET-2864-M37, MET-1040-M12, MET-2882-M12, MET-3158-M12, MET- 3158-M1 and MET-3488-M12. As shown in FIG. 14, each of these MET-targeting DsiRNAs significantly reduced MET mRNA levels in harvested mouse liver tissues, at 48 hours post-administration (formulated in Invivofectamine® 2.0 (InVitrogen) and administered at a dose of 10 mg/kg body weight). For many of the DsiRNAs examined, observed levels of mRNA knockdown were greater than 70% or even greater than 80-90% (FIG. 14). Results obtained for MET mRNA levels normalized to HPRT are shown in the left-hand panel of FIG. 14, while results obtained for MET mRNA levels normalized to GAPDH are shown in the left-hand panel of FIG. 14.

The in vivo knockdown efficacy of MET DsiRNAs in harvested tissue (here, liver) was thereby assessed and confirmed.

Example 9

Indications

The present body of knowledge in MET research indicates the need for methods to assay MET activity and for compounds that can regulate MET expression for research, diagnostic, and therapeutic use. As described herein, the nucleic acid molecules of the present invention can be used in assays to diagnose disease state related to MET levels. In addition, the nucleic acid molecules can be used to treat disease state related to MET misregulation, levels, etc.

Particular disorders and disease states that can be associated with MET expression modulation include, but are not limited to cancer and/or proliferative diseases, conditions, or disorders and other diseases, conditions or disorders that are related to or will respond to the levels of MET in a cell or tissue, alone or in combination with other therapies. Particular degenerative and disease states that are associated with MET expression modulation include but are not limited to, for example, renal, breast, lung, liver, ovarian, cervical, esophageal, oropharyngeal and pancreatic cancer.

Gemcitabine and cyclophosphamide are non-limiting examples of chemotherapeutic agents that can be combined with or used in conjunction with the nucleic acid molecules (e.g. DsiRNA molecules) of the instant invention. Those skilled in the art will recognize that other drugs such as anti-cancer compounds and therapies can be similarly be readily combined with the nucleic acid molecules of the instant invention (e.g. DsiRNA molecules) and are hence within the scope of the instant invention. Such compounds and therapies are well known in the art (see for example Cancer: Principles and Practice of Oncology, Volumes 1 and 2, eds Devita, V. T., Hellman, S., and Rosenberg, S. A., J. B. Lippincott Company, Philadelphia, USA) and include, without limitations, antifolates; fluoropyrimidines; cytarabine; purine analogs; adenosine analogs; amsacrine; topoisomerase I inhibitors; anthrapyrazoles; retinoids; antibiotics such as bleomycin, anthacyclins, mitomycin C, dactinomycin, and mithramycin; hexamethylmelamine; dacarbazine; 1-asperginase; platinum analogs; alkylating agents such as nitrogen mustard, melphalan, chlorambucil, busulfan, ifosfamide, 4-hydroperoxycyclophosphamide, nitrosoureas, thiotepa; plant derived compounds such as vinca alkaloids, epipodophyllotoxins, taxol; Tamoxifen; radiation therapy; surgery; nutritional supplements; gene therapy; radiotherapy such as 3D-CRT; immunotoxin therapy such as ricin, monoclonal antibodies Herceptin; and the like. For combination therapy, the nucleic acids of the invention are prepared in one of two ways. First, the agents are physically combined in a preparation of nucleic acid and chemotherapeutic agent, such as a mixture of a nucleic acid of the invention encapsulated in liposomes and ifosfamide in a solution for intravenous administration, wherein both agents are present in a therapeutically effective concentration (e.g., ifosfamide in solution to deliver 1000-1250 mg/m2/day and liposome-associated nucleic acid of the invention in the same solution to deliver 0.1-100 mg/kg/day). Alternatively, the agents are administered separately but simultaneously in their respective effective doses (e.g., 1000-1250 mg/m2/d ifosfamide and 0.1 to 100 mg/kg/day nucleic acid of the invention).

Those skilled in the art will recognize that other compounds and therapies used to treat the diseases and conditions described herein can similarly be combined with the nucleic acid molecules of the instant invention (e.g. siNA molecules) and are hence within the scope of the instant invention.

Example 10

Serum Stability for DsiRNAs

Serum stability of DsiRNA agents is assessed via incubation of DsiRNA agents in 50% fetal bovine serum for various periods of time (up to 24 h) at 37° C. Serum is extracted and the nucleic acids are separated on a 20% non-denaturing PAGE and can be visualized with Gelstar stain. Relative levels of protection from nuclease degradation are assessed for DsiRNAs (optionally with and without modifications).

Example 11

Use of Additional Cell Culture Models to Evaluate the Down-Regulation of MET Gene Expression A variety of endpoints have been used in cell culture models to look at MET-mediated effects after treatment with anti-MET agents. Phenotypic endpoints include inhibition of cell proliferation, RNA expression, and reduction of MET protein expression. Because MET mutations are directly associated with increased proliferation of certain tumor cells, a proliferation endpoint for cell culture assays is can be used as a screen. There are several methods by which this endpoint can be measured. Following treatment of cells with DsiRNA, cells are allowed to grow (typically 5 days), after which the cell viability, the incorporation of bromodeoxyuridine (BrdU) into cellular DNA and/or the cell density are measured. The assay of cell density can be done in a 96-well format using commercially available fluorescent nucleic acid stains (such as Syto® 13 or CyQuant®). As a secondary, confirmatory endpoint, a DsiRNA-mediated decrease in the level of MET protein expression can be evaluated using a MET-specific ELISA. The following are exemplary cell lines for use in such assays (e.g., assays performed as described in Munshi et al., *Mol Cancer Ther* 2010 9: 1544-1553; and Zhang et al., *Mol Cancer Ther* 2005 4: 1577-1584): MHCC97, HT29, MKN-45, MDA-MB-231, A549, DLD-1, A375 and SK-OV-3 cells.

Example 12

Evaluation of Anti-MET DsiRNA Efficacy in a Mouse Model of MET Misregulation

Anti-MET DsiRNA chosen from in vitro assays can be further tested in mouse models, including, e.g., xenograft and other animal models as recited above. As referred to in Example 12, exemplary appropriate cell lines for use in xenograft assays include MHCC97, HT29, MKN-45 and MDA-MB-231 cells. In one example, mice possessing misregulated (e.g., elevated) MET levels are administered a DsiRNA agent of the present invention via hydrodynamic tail vein injection. 3-4 mice per group (divided based upon specific DsiRNA agent tested) are injected with 50 µg or 200 µg of DsiRNA. Levels of MET RNA are evaluated using RT-qPCR. Additionally or alternatively, levels of MET (e.g., MET protein levels and/or cancer cell/tumor formation, growth or spread) can be evaluated using an art-recognized method, or phenotypes associated with misregulation of MET (e.g., tumor formation, growth, metastasis, etc.) are monitored (optionally as a proxy for measurement of MET transcript or MET protein levels). Active DsiRNA in such animal models can also be subsequently tested in combination with standard chemotherapies.

Example 13

Diagnostic Uses

The DsiRNA molecules of the invention can be used in a variety of diagnostic applications, such as in the identification of molecular targets (e.g., RNA) in a variety of applications, for example, in clinical, industrial, environmental, agricultural and/or research settings. Such diagnostic use of DsiRNA molecules involves utilizing reconstituted RNAi systems, for example, using cellular lysates or partially purified cellular lysates. DsiRNA molecules of this invention can be used as diagnostic tools to examine genetic drift and mutations within diseased cells. The close relationship between DsiRNA activity and the structure of the target MET RNA allows the detection of mutations in a region of the MET molecule, which alters the base-pairing and three-dimensional structure of the target MET RNA. By using multiple DsiRNA molecules described in this invention, one can map nucleotide changes, which are important to RNA structure and function in vitro, as well as in cells and tissues. Cleavage of target MET RNAs with DsiRNA molecules can be used to inhibit gene expression and define the role of specified gene products in the progression of a MET-associated disease or disorder. In this manner, other genetic targets can be defined as important mediators of the disease. These experiments will lead to better treatment of the disease progression by affording the possibility of combination therapies (e.g., multiple DsiRNA molecules targeted to different genes, DsiRNA molecules coupled with known small molecule inhibitors, or intermittent treatment with combinations of DsiRNA molecules and/or other chemical or biological molecules). Other in vitro uses of DsiRNA molecules of this invention are well known in the art, and include detection of the presence of RNAs associated with a disease or related condition. Such RNA is detected by determining the presence of a cleavage product after treatment with a DsiRNA using standard methodologies, for example, fluorescence resonance emission transfer (FRET).

In a specific example, DsiRNA molecules that cleave only wild-type or mutant or polymorphic forms of the target MET RNA are used for the assay. The first DsiRNA molecules (i.e., those that cleave only wild-type forms of target MET RNA) are used to identify wild-type MET RNA present in the sample and the second DsiRNA molecules (i.e., those that cleave only mutant or polymorphic forms of target RNA) are used to identify mutant or polymorphic MET RNA in the sample. As reaction controls, synthetic substrates of both wild-type and mutant or polymorphic MET RNA are cleaved by both DsiRNA molecules to demonstrate the relative DsiRNA efficiencies in the reactions and the absence of cleavage of the "non-targeted" MET RNA species. The cleavage products from the synthetic substrates also serve to generate size markers for the analysis of wild-type and mutant MET RNAs in the sample population. Thus, each analysis requires two DsiRNA molecules, two substrates and one unknown sample, which is combined into six reactions. The presence of cleavage products is determined using an RNase protection assay so that full-length and cleavage fragments of each MET RNA can be analyzed in one lane of a polyacrylamide gel. It is not absolutely required to quantify the results to gain insight into the expression of mutant or polymorphic MET RNAs and putative risk of MET-associated phenotypic changes in target cells. The expression of MET mRNA whose protein product is implicated in the development of the phenotype (i.e., disease related/associated) is adequate to establish risk. If probes of comparable specific activity are used for both transcripts, then a qualitative comparison of MET RNA levels is adequate and decreases the cost of the initial diagnosis. Higher mutant or polymorphic form to wild-type ratios are correlated with higher risk whether MET RNA levels are compared qualitatively or quantitatively.

All patents and publications mentioned in the specification are indicative of the levels of skill of those skilled in the art to which the invention pertains. All references cited in this disclosure are incorporated by reference to the same extent as if each reference had been incorporated by reference in its entirety individually.

One skilled in the art would readily appreciate that the present invention is well adapted to carry out the objects and obtain the ends and advantages mentioned, as well as those inherent therein. The methods and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications can be made to the invention disclosed herein without departing from the scope and spirit of the invention. Thus, such additional embodiments are within the scope of the present invention and the following claims. The present invention teaches one skilled in the art to test various combinations and/or substitutions of chemical modifications described herein toward generating nucleic acid constructs with improved activity for mediating RNAi activity. Such improved activity can comprise improved stability, improved bioavailability, and/or improved activation of cellular responses mediating RNAi. Therefore, the specific embodiments described herein are not limiting and one skilled in the art can readily appreciate that specific combinations of the modifications described herein can be tested without undue experimentation toward identifying DsiRNA molecules with improved RNAi activity.

The invention illustratively described herein suitably can be practiced in the absence of any element or elements, limitation or limitations that are not specifically disclosed herein. Thus, for example, in each instance herein any of the terms "comprising", "consisting essentially of", and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments, optional features, modification and variation of the concepts herein disclosed may be resorted to by those skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Embodiments of this invention are described herein, including the best mode known to the inventors for carrying out the invention. Variations of those embodiments may become apparent to those of ordinary skill in the art upon reading the foregoing description.

The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context. Those skilled in the art will recognize, or be able to ascertain using no more than routine experimentation, many equivalents to the specific embodiments of the invention described herein. Such equivalents are intended to be encompassed by the following claims.

SEQUENCE LISTING (3056 sequences)

SEQ ID NO: 1 - DNA, 25 bp, Artificial Sequence
  Synthetic oligonucleotide
cgcggagcgcgcgugugguccuugc

SEQ ID NO: 2 - DNA, 25 bp, Artificial Sequence
  Synthetic oligonucleotide
gcggagcgcgcgugugguccuugcg

SEQ ID NO: 3 - DNA, 25 bp, Artificial Sequence
  Synthetic oligonucleotide
cggagcgcgcgugugguccuugcgc

SEQ ID NO: 4 - DNA, 25 bp, Artificial Sequence
  Synthetic oligonucleotide
gagcgcgcgugugguccuugcgccg

SEQ ID NO: 5 - DNA, 25 bp, Artificial Sequence
  Synthetic oligonucleotide
gcgcgcgugugguccuugcgccgct

SEQ ID NO: 6 - DNA, 25 bp, Artificial Sequence
  Synthetic oligonucleotide
cgcgcgugugguccuugcgccgctg

SEQ ID NO: 7 - DNA, 25 bp, Artificial Sequence
  Synthetic oligonucleotide
cgcgugugguccuugcgccgcugac

SEQ ID NO: 8 - DNA, 25 bp, Artificial Sequence
  Synthetic oligonucleotide
gcgugugguccuugcgccgcugact

SEQ ID NO: 9 - DNA, 25 bp, Artificial Sequence
  Synthetic oligonucleotide
gugugguccuugcgccgcugacutc

SEQ ID NO: 10 - DNA, 25 bp, Artificial Sequence
  Synthetic oligonucleotide
ccuugcgccgcugacuucuccactg

SEQ ID NO: 11 - DNA, 25 bp, Artificial Sequence
  Synthetic oligonucleotide
gcgccgcugacuucuccacuggutc

SEQ ID NO: 12 - DNA, 25 bp, Artificial Sequence
  Synthetic oligonucleotide
cugugcuugcaccuggcauccucgt

SEQ ID NO: 13 - DNA, 25 bp, Artificial Sequence
  Synthetic oligonucleotide
gugcuugcaccuggcauccucgugc

SEQ ID NO: 14 - DNA, 25 bp, Artificial Sequence
  Synthetic oligonucleotide
caccuggcauccucgugcuccugtt

SEQ ID NO: 15 - DNA, 25 bp, Artificial Sequence
  Synthetic oligonucleotide
cucgugcuccuguuuaccuuggugc

SEQ ID NO: 16 - DNA, 25 bp, Artificial Sequence
  Synthetic oligonucleotide
gugcuccuguuuaccuuggugcaga

SEQ ID NO: 17 - DNA, 25 bp, Artificial Sequence
  Synthetic oligonucleotide
ugcuccuguuuaccuuggugcagag

SEQ ID NO: 18 - DNA, 25 bp, Artificial Sequence
  Synthetic oligonucleotide
cacuaacuacauuuauguuuuaaat

SEQ ID NO: 19 - DNA, 25 bp, Artificial Sequence
  Synthetic oligonucleotide
aacuacauuuauguuuuaaaugagg

SEQ ID NO: 20 - DNA, 25 bp, Artificial Sequence
  Synthetic oligonucleotide
acuacauuuauguuuuaaaugagga

SEQ ID NO: 21 - DNA, 25 bp, Artificial Sequence
  Synthetic oligonucleotide
cuacauuuauguuuuaaaugaggaa

SEQ ID NO: 22 - DNA, 25 bp, Artificial Sequence
  Synthetic oligonucleotide
uacauuuauguuuuaaaugaggaag

SEQ ID NO: 23 - DNA, 25 bp, Artificial Sequence
  Synthetic oligonucleotide
acauuuauguuuuaaaugaggaaga

SEQ ID NO: 24 - DNA, 25 bp, Artificial Sequence
  Synthetic oligonucleotide
uggaacacccagauuguuucccatg

SEQ ID NO: 25 - DNA, 25 bp, Artificial Sequence
  Synthetic oligonucleotide
ggacugcagcagcaaagccaauuta

SEQ ID NO: 26 - DNA, 25 bp, Artificial Sequence
  Synthetic oligonucleotide
gacugcagcagcaaagccaauuuat

SEQ ID NO: 27 - DNA, 25 bp, Artificial Sequence
  Synthetic oligonucleotide
acugcagcagcaaagccaauuuatc

SEQ ID NO: 28 - DNA, 25 bp, Artificial Sequence
  Synthetic oligonucleotide
cugcagcagcaaagccaauuuauca

SEQ ID NO: 29 - DNA, 25 bp, Artificial Sequence
  Synthetic oligonucleotide
ugcagcagcaaagccaauuuaucag

SEQ ID NO: 30 - DNA, 25 bp, Artificial Sequence
  Synthetic oligonucleotide
uacuaugaugaucaacucauuagct

SEQ ID NO: 31 - DNA, 25 bp, Artificial Sequence
  Synthetic oligonucleotide
acuaugaugaucaacucauuagctg

SEQ ID NO: 32 - DNA, 25 bp, Artificial Sequence
  Synthetic oligonucleotide
cuaugaugaucaacucauuagcugt

SEQ ID NO: 33 - DNA, 25 bp, Artificial Sequence
  Synthetic oligonucleotide
uaugaugaucaacucauuagcugtg

SEQ ID NO: 34 - DNA, 25 bp, Artificial Sequence
  Synthetic oligonucleotide
augaugaucaacucauuagcugugg

SEQ ID NO: 35 - DNA, 25 bp, Artificial Sequence
  Synthetic oligonucleotide
ugaugaucaacucauuagcuguggc

SEQ ID NO: 36 - DNA, 25 bp, Artificial Sequence
  Synthetic oligonucleotide
gaugaucaacucauuagcuguggca

SEQ ID NO: 37 - DNA, 25 bp, Artificial Sequence
  Synthetic oligonucleotide
augaucaacucauuagcuguggcag

SEQ ID NO: 38 - DNA, 25 bp, Artificial Sequence
  Synthetic oligonucleotide
ugaucaacucauuagcuguggcagc

SEQ ID NO: 39 - DNA, 25 bp, Artificial Sequence
  Synthetic oligonucleotide
gaucaacucauuagcuguggcagcg

SEQ ID NO: 40 - DNA, 25 bp, Artificial Sequence
  Synthetic oligonucleotide
aucaacucauuagcuguggcagcgt

SEQ ID NO: 41 - DNA, 25 bp, Artificial Sequence
  Synthetic oligonucleotide
ucaacucauuagcuguggcagcgtc

SEQ ID NO: 42 - DNA, 25 bp, Artificial Sequence
  Synthetic oligonucleotide
caacucauuagcuguggcagcguca

SEQ ID NO: 43 - DNA, 25 bp, Artificial Sequence
  Synthetic oligonucleotide
aacucauuagcuguggcagcgucaa

SEQ ID NO: 44 - DNA, 25 bp, Artificial Sequence
  Synthetic oligonucleotide
gaugguuuuauguuuuugacggacc

SEQ ID NO: 45 - DNA, 25 bp, Artificial Sequence
  Synthetic oligonucleotide
cuuugaaagcaacaauuuuauuuac

SEQ ID NO: 46 - DNA, 25 bp, Artificial Sequence
  Synthetic oligonucleotide
ggaaacucuagaugcucagacuutt

SEQ ID NO: 47 - DNA, 25 bp, Artificial Sequence
  Synthetic oligonucleotide
gaaacucuagaugcucagacuuutc

SEQ ID NO: 48 - DNA, 25 bp, Artificial Sequence
  Synthetic oligonucleotide
aaacucuagaugcucagacuuuuca

SEQ ID NO: 49 - DNA, 25 bp, Artificial Sequence
  Synthetic oligonucleotide
aacucuagaugcucagacuuuucac

SEQ ID NO: 50 - DNA, 25 bp, Artificial Sequence
  Synthetic oligonucleotide
acucuagaugcucagacuuuucaca

SEQ ID NO: 51 - DNA, 25 bp, Artificial Sequence
  Synthetic oligonucleotide
cucuagaugcucagacuuuucacac

SEQ ID NO: 52 - DNA, 25 bp, Artificial Sequence
  Synthetic oligonucleotide
cacaagaauaaucagguucuguucc

SEQ ID NO: 53 - DNA, 25 bp, Artificial Sequence
  Synthetic oligonucleotide
caagaauaaucagguucuguuccat

SEQ ID NO: 54 - DNA, 25 bp, Artificial Sequence
  Synthetic oligonucleotide
aagaauaaucagguucuguuccata

SEQ ID NO: 55 - DNA, 25 bp, Artificial Sequence
  Synthetic oligonucleotide
agaauaaucagguucuguuccauaa

SEQ ID NO: 56 - DNA, 25 bp, Artificial Sequence
  Synthetic oligonucleotide
gaauaaucagguucuguuccauaaa

SEQ ID NO: 57 - DNA, 25 bp, Artificial Sequence
  Synthetic oligonucleotide
aauaaucagguucuguuccauaaac

SEQ ID NO: 58 - DNA, 25 bp, Artificial Sequence
  Synthetic oligonucleotide
guuccauaaacucuggauugcautc

SEQ ID NO: 59 - DNA, 25 bp, Artificial Sequence
  Synthetic oligonucleotide
ggaguguauucucacagaaaagaga

SEQ ID NO: 60 - DNA, 25 bp, Artificial Sequence
  Synthetic oligonucleotide
ggaaguguuuaauauacuucaggct

SEQ ID NO: 61 - DNA, 25 bp, Artificial Sequence
  Synthetic oligonucleotide
caggcugcguaugucagcaagcctg

SEQ ID NO: 62 - DNA, 25 bp, Artificial Sequence
  Synthetic oligonucleotide
gcacaaagcaagccagauucugccg

SEQ ID NO: 63 - DNA, 25 bp, Artificial Sequence
  Synthetic oligonucleotide
cacaaagcaagccagauucugccga

SEQ ID NO: 64 - DNA, 25 bp, Artificial Sequence
  Synthetic oligonucleotide
acaaagcaagccagauucugccgaa

SEQ ID NO: 65 - DNA, 25 bp, Artificial Sequence
  Synthetic oligonucleotide
caaagcaagccagauucugccgaac

SEQ ID NO: 66 - DNA, 25 bp, Artificial Sequence
  Synthetic oligonucleotide
aaagcaagccagauucugccgaacc

SEQ ID NO: 67 - DNA, 25 bp, Artificial Sequence
  Synthetic oligonucleotide
gugagaugucuccagcauuuuuacg

SEQ ID NO: 68 - DNA, 25 bp, Artificial Sequence
  Synthetic oligonucleotide
ugagaugucuccagcauuuuuacgg

SEQ ID NO: 69 - DNA, 25 bp, Artificial Sequence
  Synthetic oligonucleotide
gagaugucuccagcauuuuuacgga

SEQ ID NO: 70 - DNA, 25 bp, Artificial Sequence
  Synthetic oligonucleotide
agaugucuccagcauuuuuacggac

SEQ ID NO: 71 - DNA, 25 bp, Artificial Sequence
  Synthetic oligonucleotide
gaugucuccagcauuuuuacggacc

SEQ ID NO: 72 - DNA, 25 bp, Artificial Sequence
  Synthetic oligonucleotide
augucuccagcauuuuuacggaccc

SEQ ID NO: 73 - DNA, 25 bp, Artificial Sequence
  Synthetic oligonucleotide
ugucuccagcauuuuuacggaccca

SEQ ID NO: 74 - DNA, 25 bp, Artificial Sequence
  Synthetic oligonucleotide
gucuccagcauuuuuacggacccaa

SEQ ID NO: 75 - DNA, 25 bp, Artificial Sequence
  Synthetic oligonucleotide
ucuccagcauuuuuacggacccaat

SEQ ID NO: 76 - DNA, 25 bp, Artificial Sequence
  Synthetic oligonucleotide
cuccagcauuuuuacggacccaatc

SEQ ID NO: 77 - DNA, 25 bp, Artificial Sequence
  Synthetic oligonucleotide
uccagcauuuuuacggacccaauca

SEQ ID NO: 78 - DNA, 25 bp, Artificial Sequence
  Synthetic oligonucleotide
ccagcauuuuuacggacccaaucat

SEQ ID NO: 79 - DNA, 25 bp, Artificial Sequence
  Synthetic oligonucleotide
cagcauuuuuacggacccaaucatg

SEQ ID NO: 80 - DNA, 25 bp, Artificial Sequence
  Synthetic oligonucleotide
agcauuuuuacggacccaaucauga

SEQ ID NO: 81 - DNA, 25 bp, Artificial Sequence
  Synthetic oligonucleotide
uuuaccacagcuuugcagcgcgutg

SEQ ID NO: 82 - DNA, 25 bp, Artificial Sequence
  Synthetic oligonucleotide
uaccacagcuuugcagcgcguugac

SEQ ID NO: 83 - DNA, 25 bp, Artificial Sequence
  Synthetic oligonucleotide
ccacagcuuugcagcgcguugactt

SEQ ID NO: 84 - DNA, 25 bp, Artificial Sequence
  Synthetic oligonucleotide
cacagcuuugcagcgcguugacuta

SEQ ID NO: 85 - DNA, 25 bp, Artificial Sequence
  Synthetic oligonucleotide
cagcuuugcagcgcguugacuuatt

SEQ ID NO: 86 - DNA, 25 bp, Artificial Sequence
  Synthetic oligonucleotide
gcuuugcagcgcguugacuuauuca

SEQ ID NO: 87 - DNA, 25 bp, Artificial Sequence
  Synthetic oligonucleotide
cuuugcagcgcguugacuuauucat

SEQ ID NO: 88 - DNA, 25 bp, Artificial Sequence
  Synthetic oligonucleotide
uuugcagcgcguugacuuauucatg

SEQ ID NO: 89 - DNA, 25 bp, Artificial Sequence
  Synthetic oligonucleotide
uugcagcgcguugacuuauucaugg

SEQ ID NO: 90 - DNA, 25 bp, Artificial Sequence
  Synthetic oligonucleotide
ugaccauauguggcugggacuuugg

SEQ ID NO: 91 - DNA, 25 bp, Artificial Sequence
  Synthetic oligonucleotide
gaccauauguggcugggacuuugga

SEQ ID NO: 92 - DNA, 25 bp, Artificial Sequence
  Synthetic oligonucleotide
accauauguggcugggacuuuggat

SEQ ID NO: 93 - DNA, 25 bp, Artificial Sequence
  Synthetic oligonucleotide
ccauauguggcugggacuuuggatt

SEQ ID NO: 94 - DNA, 25 bp, Artificial Sequence
  Synthetic oligonucleotide
cauauguggcugggacuuuggautt

SEQ ID NO: 95 - DNA, 25 bp, Artificial Sequence
  Synthetic oligonucleotide
auauguggcugggacuuuggauutc

SEQ ID NO: 96 - DNA, 25 bp, Artificial Sequence
  Synthetic oligonucleotide
uauguggcugggacuuuggauuucg

SEQ ID NO: 97 - DNA, 25 bp, Artificial Sequence
  Synthetic oligonucleotide
auguggcugggacuuuggauuucgg

SEQ ID NO: 98 - DNA, 25 bp, Artificial Sequence
  Synthetic oligonucleotide
uguggcugggacuuuggauuucgga

SEQ ID NO: 99 - DNA, 25 bp, Artificial Sequence
  Synthetic oligonucleotide
guggcugggacuuuggauuucggag

SEQ ID NO: 100 - DNA, 25 bp, Artificial Sequence
  Synthetic oligonucleotide
cggaggaauaauaaauuugauuuaa

SEQ ID NO: 101 - DNA, 25 bp, Artificial Sequence
  Synthetic oligonucleotide
gaauaauaaauuugauuuaaagaaa

SEQ ID NO: 102 - DNA, 25 bp, Artificial Sequence
  Synthetic oligonucleotide
aauaauaaauuugauuuaaagaaaa

SEQ ID NO: 103 - DNA, 25 bp, Artificial Sequence
  Synthetic oligonucleotide
uugaaaugcacaguugguccugcca

SEQ ID NO: 104 - DNA, 25 bp, Artificial Sequence
  Synthetic oligonucleotide
ugaaaugcacaguugguccugccat

SEQ ID NO: 105 - DNA, 25 bp, Artificial Sequence
  Synthetic oligonucleotide
caauauguccauaauuauuucaaat

SEQ ID NO: 106 - DNA, 25 bp, Artificial Sequence
  Synthetic oligonucleotide
uggaaaaacauguacuuuaaaaagt

SEQ ID NO: 107 - DNA, 25 bp, Artificial Sequence
  Synthetic oligonucleotide
uaccacuccuucccugcaacagctg

SEQ ID NO: 108 - DNA, 25 bp, Artificial Sequence
  Synthetic oligonucleotide
agccuuuugaaaagccagugaugat

SEQ ID NO: 109 - DNA, 25 bp, Artificial Sequence
  Synthetic oligonucleotide
auauugacccugaagcaguuaaagg

SEQ ID NO: 110 - DNA, 25 bp, Artificial Sequence
  Synthetic oligonucleotide
uauugacccugaagcaguuaaaggt

SEQ ID NO: 111 - DNA, 25 bp, Artificial Sequence
  Synthetic oligonucleotide
auugacccugaagcaguuaaaggtg

SEQ ID NO: 112 - DNA, 25 bp, Artificial Sequence
  Synthetic oligonucleotide
uugacccugaagcaguuaaagguga

SEQ ID NO: 113 - DNA, 25 bp, Artificial Sequence
  Synthetic oligonucleotide
ugacccugaagcaguuaaaggugaa

SEQ ID NO: 114 - DNA, 25 bp, Artificial Sequence
  Synthetic oligonucleotide
gacccugaagcaguuaaaggugaag

SEQ ID NO: 115 - DNA, 25 bp, Artificial Sequence
  Synthetic oligonucleotide
acccugaagcaguuaaaggugaagt

SEQ ID NO: 116 - DNA, 25 bp, Artificial Sequence
  Synthetic oligonucleotide
cccugaagcaguuaaaggugaagtg

SEQ ID NO: 117 - DNA, 25 bp, Artificial Sequence
  Synthetic oligonucleotide
ccugaagcaguuaaaggugaagugt

SEQ ID NO: 118 - DNA, 25 bp, Artificial Sequence
  Synthetic oligonucleotide
cugaagcaguuaaaggugaagugtt

SEQ ID NO: 119 - DNA, 25 bp, Artificial Sequence
  Synthetic oligonucleotide
ugaagcaguuaaaggugaaguguta

SEQ ID NO: 120 - DNA, 25 bp, Artificial Sequence
  Synthetic oligonucleotide
gaagcaguuaaaggugaaguguuaa

SEQ ID NO: 121 - DNA, 25 bp, Artificial Sequence
  Synthetic oligonucleotide
aagcaguuaaaggugaaguguuaaa

SEQ ID NO: 122 - DNA, 25 bp, Artificial Sequence
  Synthetic oligonucleotide
agcaguuaaaggugaaguguuaaaa

SEQ ID NO: 123 - DNA, 25 bp, Artificial Sequence
  Synthetic oligonucleotide
gcaguuaaaggugaaguguuaaaag

SEQ ID NO: 124 - DNA, 25 bp, Artificial Sequence
  Synthetic oligonucleotide
caguuaaaggugaaguguuaaaagt

SEQ ID NO: 125 - DNA, 25 bp, Artificial Sequence
  Synthetic oligonucleotide
aguuaaaggugaaguguuaaaagtt

SEQ ID NO: 126 - DNA, 25 bp, Artificial Sequence
  Synthetic oligonucleotide
guuaaaggugaaguguuaaaagutg

SEQ ID NO: 127 - DNA, 25 bp, Artificial Sequence
  Synthetic oligonucleotide
uuaaaggugaaguguuaaaaguugg

SEQ ID NO: 128 - DNA, 25 bp, Artificial Sequence
  Synthetic oligonucleotide
uaaaggugaaguguuaaaaguugga

SEQ ID NO: 129 - DNA, 25 bp, Artificial Sequence
  Synthetic oligonucleotide
aaaggugaaguguuaaaaguuggaa

SEQ ID NO: 130 - DNA, 25 bp, Artificial Sequence
  Synthetic oligonucleotide
aaggugaaguguuaaaaguuggaaa

SEQ ID NO: 131 - DNA, 25 bp, Artificial Sequence
  Synthetic oligonucleotide
aggugaaguguuaaaaguuggaaat

SEQ ID NO: 132 - DNA, 25 bp, Artificial Sequence
  Synthetic oligonucleotide
ggugaaguguuaaaaguuggaaata

SEQ ID NO: 133 - DNA, 25 bp, Artificial Sequence
  Synthetic oligonucleotide
gugaaguguuaaaaguuggaaauaa

SEQ ID NO: 134 - DNA, 25 bp, Artificial Sequence
  Synthetic oligonucleotide
ugaaguguuaaaaguuggaaauaag

SEQ ID NO: 135 - DNA, 25 bp, Artificial Sequence
  Synthetic oligonucleotide
gaaguguuaaaaguuggaaauaaga

SEQ ID NO: 136 - DNA, 25 bp, Artificial Sequence
  Synthetic oligonucleotide
aaguguuaaaaguuggaaauaagag

SEQ ID NO: 137 - DNA, 25 bp, Artificial Sequence
  Synthetic oligonucleotide
aguguuaaaaguuggaaauaagagc

SEQ ID NO: 138 - DNA, 25 bp, Artificial Sequence
  Synthetic oligonucleotide
ugaacagcgagcuaaauauagagtg

SEQ ID NO: 139 - DNA, 25 bp, Artificial Sequence
  Synthetic oligonucleotide
gaacagcgagcuaaauauagagugg

SEQ ID NO: 140 - DNA, 25 bp, Artificial Sequence
  Synthetic oligonucleotide
aacagcgagcuaaauauagagugga

SEQ ID NO: 141 - DNA, 25 bp, Artificial Sequence
  Synthetic oligonucleotide
acagcgagcuaaauauagaguggaa

SEQ ID NO: 142 - DNA, 25 bp, Artificial Sequence
  Synthetic oligonucleotide
cagcgagcuaaauauagaguggaag

SEQ ID NO: 143 - DNA, 25 bp, Artificial Sequence
  Synthetic oligonucleotide
agcgagcuaaauauagaguggaagc

SEQ ID NO: 144 - DNA, 25 bp, Artificial Sequence
  Synthetic oligonucleotide
gcgagcuaaauauagaguggaagca

SEQ ID NO: 145 - DNA, 25 bp, Artificial Sequence
  Synthetic oligonucleotide
cgagcuaaauauagaguggaagcaa

SEQ ID NO: 146 - DNA, 25 bp, Artificial Sequence
  Synthetic oligonucleotide
gagcuaaauauagaguggaagcaag

SEQ ID NO: 147 - DNA, 25 bp, Artificial Sequence
  Synthetic oligonucleotide
agcuaaauauagaguggaagcaagc

SEQ ID NO: 148 - DNA, 25 bp, Artificial Sequence
  Synthetic oligonucleotide
gcuaaauauagaguggaagcaagca

SEQ ID NO: 149 - DNA, 25 bp, Artificial Sequence
  Synthetic oligonucleotide
cuaaauauagaguggaagcaagcaa

SEQ ID NO: 150 - DNA, 25 bp, Artificial Sequence
  Synthetic oligonucleotide
uaaauauagaguggaagcaagcaat

SEQ ID NO: 151 - DNA, 25 bp, Artificial Sequence
  Synthetic oligonucleotide
aaauauagaguggaagcaagcaatt

SEQ ID NO: 152 - DNA, 25 bp, Artificial Sequence
  Synthetic oligonucleotide
aauauagaguggaagcaagcaautt

SEQ ID NO: 153 - DNA, 25 bp, Artificial Sequence
  Synthetic oligonucleotide
auauagaguggaagcaagcaauutc

SEQ ID NO: 154 - DNA, 25 bp, Artificial Sequence
  Synthetic oligonucleotide
uauagaguggaagcaagcaauuuct

SEQ ID NO: 155 - DNA, 25 bp, Artificial Sequence
  Synthetic oligonucleotide
uggguuuuuccuguggcugaaaaag

SEQ ID NO: 156 - DNA, 25 bp, Artificial Sequence
  Synthetic oligonucleotide
ggcugaaaaagagaaagcaaauuaa

SEQ ID NO: 157 - DNA, 25 bp, Artificial Sequence
  Synthetic oligonucleotide
uaaagaucugggcagugaauuagtt

SEQ ID NO: 158 - DNA, 25 bp, Artificial Sequence
  Synthetic oligonucleotide
aaagaucugggcagugaauuagutc

SEQ ID NO: 159 - DNA, 25 bp, Artificial Sequence
  Synthetic oligonucleotide
aagaucugggcagugaauuaguucg

SEQ ID NO: 160 - DNA, 25 bp, Artificial Sequence
  Synthetic oligonucleotide
agaucugggcagugaauuaguucgc

SEQ ID NO: 161 - DNA, 25 bp, Artificial Sequence
  Synthetic oligonucleotide
gaucugggcagugaauuaguucgct

SEQ ID NO: 162 - DNA, 25 bp, Artificial Sequence
  Synthetic oligonucleotide
aucugggcagugaauuaguucgcta

SEQ ID NO: 163 - DNA, 25 bp, Artificial Sequence
  Synthetic oligonucleotide
ucugggcagugaauuaguucgcuac

SEQ ID NO: 164 - DNA, 25 bp, Artificial Sequence
  Synthetic oligonucleotide
cugggcagugaauuaguucgcuacg

SEQ ID NO: 165 - DNA, 25 bp, Artificial Sequence
  Synthetic oligonucleotide
ugggcagugaauuaguucgcuacga

SEQ ID NO: 166 - DNA, 25 bp, Artificial Sequence
  Synthetic oligonucleotide
gggcagugaauuaguucgcuacgat

SEQ ID NO: 167 - DNA, 25 bp, Artificial Sequence
  Synthetic oligonucleotide
ggcagugaauuaguucgcuacgatg

SEQ ID NO: 168 - DNA, 25 bp, Artificial Sequence
  Synthetic oligonucleotide
gcagugaauuaguucgcuacgaugc

SEQ ID NO: 169 - DNA, 25 bp, Artificial Sequence
  Synthetic oligonucleotide
cacuccucauuuggauaggcuugta

SEQ ID NO: 170 - DNA, 25 bp, Artificial Sequence
  Synthetic oligonucleotide
acuccucauuuggauaggcuuguaa

SEQ ID NO: 171 - DNA, 25 bp, Artificial Sequence
  Synthetic oligonucleotide
cuccucauuuggauaggcuuguaag

SEQ ID NO: 172 - DNA, 25 bp, Artificial Sequence
  Synthetic oligonucleotide
uccucauuuggauaggcuuguaagt

SEQ ID NO: 173 - DNA, 25 bp, Artificial Sequence
  Synthetic oligonucleotide
ccucauuuggauaggcuuguaagtg

SEQ ID NO: 174 - DNA, 25 bp, Artificial Sequence
  Synthetic oligonucleotide
cucauuuggauaggcuuguaagugc

SEQ ID NO: 175 - DNA, 25 bp, Artificial Sequence
  Synthetic oligonucleotide
ucauuuggauaggcuuguaagugcc

SEQ ID NO: 176 - DNA, 25 bp, Artificial Sequence
  Synthetic oligonucleotide
cauuuggauaggcuuguaagugccc

SEQ ID NO: 177 - DNA, 25 bp, Artificial Sequence
  Synthetic oligonucleotide
auuuggauaggcuuguaagugcccg

SEQ ID NO: 178 - DNA, 25 bp, Artificial Sequence
  Synthetic oligonucleotide
uuuggauaggcuuguaagugcccga

SEQ ID NO: 179 - DNA, 25 bp, Artificial Sequence
  Synthetic oligonucleotide
uuggauaggcuuguaagugcccgaa

SEQ ID NO: 180 - DNA, 25 bp, Artificial Sequence
  Synthetic oligonucleotide
uggauaggcuuguaagugcccgaag

SEQ ID NO: 181 - DNA, 25 bp, Artificial Sequence
  Synthetic oligonucleotide
ggauaggcuuguaagugcccgaagt

SEQ ID NO: 182 - DNA, 25 bp, Artificial Sequence
  Synthetic oligonucleotide
gauaggcuuguaagugcccgaagtg

SEQ ID NO: 183 - DNA, 25 bp, Artificial Sequence
  Synthetic oligonucleotide
auaggcuuguaagugcccgaagugt

SEQ ID NO: 184 - DNA, 25 bp, Artificial Sequence
  Synthetic oligonucleotide
uaggcuuguaagugcccgaagugta

SEQ ID NO: 185 - DNA, 25 bp, Artificial Sequence
  Synthetic oligonucleotide
aggcuuguaagugcccgaaguguaa

SEQ ID NO: 186 - DNA, 25 bp, Artificial Sequence
  Synthetic oligonucleotide
ggcuuguaagugcccgaaguguaag

SEQ ID NO: 187 - DNA, 25 bp, Artificial Sequence
  Synthetic oligonucleotide
gcuuguaagugcccgaaguguaagc

SEQ ID NO: 188 - DNA, 25 bp, Artificial Sequence
  Synthetic oligonucleotide
cuuguaagugcccgaaguguaagcc

SEQ ID NO: 189 - DNA, 25 bp, Artificial Sequence
  Synthetic oligonucleotide
uuguaagugcccgaaguguaagccc

SEQ ID NO: 190 - DNA, 25 bp, Artificial Sequence
  Synthetic oligonucleotide
uguaagugcccgaaguguaagccca

SEQ ID NO: 191 - DNA, 25 bp, Artificial Sequence
  Synthetic oligonucleotide
guaagugcccgaaguguaagcccaa

SEQ ID NO: 192 - DNA, 25 bp, Artificial Sequence
  Synthetic oligonucleotide
uaagugcccgaaguguaagcccaac

SEQ ID NO: 193 - DNA, 25 bp, Artificial Sequence
  Synthetic oligonucleotide
gagcuacuuuuccagaagaucagtt

SEQ ID NO: 194 - DNA, 25 bp, Artificial Sequence
  Synthetic oligonucleotide
cacauugaccucagugcucuaaatc

SEQ ID NO: 195 - DNA, 25 bp, Artificial Sequence
  Synthetic oligonucleotide
acauugaccucagugcucuaaaucc

SEQ ID NO: 196 - DNA, 25 bp, Artificial Sequence
  Synthetic oligonucleotide
cauugaccucagugcucuaaaucca

SEQ ID NO: 197 - DNA, 25 bp, Artificial Sequence
  Synthetic oligonucleotide
auugaccucagugcucuaaauccag

SEQ ID NO: 198 - DNA, 25 bp, Artificial Sequence
  Synthetic oligonucleotide
uugaccucagugcucuaaauccaga

SEQ ID NO: 199 - DNA, 25 bp, Artificial Sequence
  Synthetic oligonucleotide
ugaccucagugcucuaaauccagag

SEQ ID NO: 200 - DNA, 25 bp, Artificial Sequence
  Synthetic oligonucleotide
gaccucagugcucuaaauccagagc

SEQ ID NO: 201 - DNA, 25 bp, Artificial Sequence
  Synthetic oligonucleotide
accucagugcucuaaauccagagct

SEQ ID NO: 202 - DNA, 25 bp, Artificial Sequence
  Synthetic oligonucleotide
ccucagugcucuaaauccagagctg

SEQ ID NO: 203 - DNA, 25 bp, Artificial Sequence
  Synthetic oligonucleotide
cucagugcucuaaauccagagcugg

SEQ ID NO: 204 - DNA, 25 bp, Artificial Sequence
  Synthetic oligonucleotide
ucagugcucuaaauccagagcuggt

SEQ ID NO: 205 - DNA, 25 bp, Artificial Sequence
  Synthetic oligonucleotide
cagugcucuaaauccagagcuggtc

SEQ ID NO: 206 - DNA, 25 bp, Artificial Sequence
  Synthetic oligonucleotide
agugcucuaaauccagagcuggucc

SEQ ID NO: 207 - DNA, 25 bp, Artificial Sequence
  Synthetic oligonucleotide
gugcucuaaauccagagcuggucca

SEQ ID NO: 208 - DNA, 25 bp, Artificial Sequence
  Synthetic oligonucleotide
ugcucuaaauccagagcugguccag

SEQ ID NO: 209 - DNA, 25 bp, Artificial Sequence
  Synthetic oligonucleotide
gcucuaaauccagagcugguccagg

SEQ ID NO: 210 - DNA, 25 bp, Artificial Sequence
  Synthetic oligonucleotide
cucuaaauccagagcugguccaggc

SEQ ID NO: 211 - DNA, 25 bp, Artificial Sequence
  Synthetic oligonucleotide
ucuaaauccagagcugguccaggca

SEQ ID NO: 212 - DNA, 25 bp, Artificial Sequence
  Synthetic oligonucleotide
cuaaauccagagcugguccaggcag

SEQ ID NO: 213 - DNA, 25 bp, Artificial Sequence
  Synthetic oligonucleotide
uaaauccagagcugguccaggcagt

SEQ ID NO: 214 - DNA, 25 bp, Artificial Sequence
  Synthetic oligonucleotide
agccugauugugcauuucaaugaag

SEQ ID NO: 215 - DNA, 25 bp, Artificial Sequence
  Synthetic oligonucleotide
gccugauugugcauuucaaugaagt

SEQ ID NO: 216 - DNA, 25 bp, Artificial Sequence
  Synthetic oligonucleotide
ccugauugugcauuucaaugaagtc

SEQ ID NO: 217 - DNA, 25 bp, Artificial Sequence
  Synthetic oligonucleotide
cugauugugcauuucaaugaaguca

SEQ ID NO: 218 - DNA, 25 bp, Artificial Sequence
  Synthetic oligonucleotide
ugauugugcauuucaaugaagucat

SEQ ID NO: 219 - DNA, 25 bp, Artificial Sequence
  Synthetic oligonucleotide
gauugugcauuucaaugaagucata

SEQ ID NO: 220 - DNA, 25 bp, Artificial Sequence
  Synthetic oligonucleotide
auugugcauuucaaugaagucauag

SEQ ID NO: 221 - DNA, 25 bp, Artificial Sequence
  Synthetic oligonucleotide
uugugcauuucaaugaagucauagg

SEQ ID NO: 222 - DNA, 25 bp, Artificial Sequence
  Synthetic oligonucleotide
ugugcauuucaaugaagucauagga

SEQ ID NO: 223 - DNA, 25 bp, Artificial Sequence
  Synthetic oligonucleotide
gugcauuucaaugaagucauaggaa

SEQ ID NO: 224 - DNA, 25 bp, Artificial Sequence
  Synthetic oligonucleotide
ugcauuucaaugaagucauaggaag

SEQ ID NO: 225 - DNA, 25 bp, Artificial Sequence
  Synthetic oligonucleotide
gcauuucaaugaagucauaggaaga

SEQ ID NO: 226 - DNA, 25 bp, Artificial Sequence
  Synthetic oligonucleotide
cauuucaaugaagucauaggaagag

SEQ ID NO: 227 - DNA, 25 bp, Artificial Sequence
  Synthetic oligonucleotide
auuucaaugaagucauaggaagagg

SEQ ID NO: 228 - DNA, 25 bp, Artificial Sequence
  Synthetic oligonucleotide
uuucaaugaagucauaggaagaggg

SEQ ID NO: 229 - DNA, 25 bp, Artificial Sequence
  Synthetic oligonucleotide
uucaaugaagucauaggaagagggc

SEQ ID NO: 230 - DNA, 25 bp, Artificial Sequence
  Synthetic oligonucleotide
ucaaugaagucauaggaagagggca

SEQ ID NO: 231 - DNA, 25 bp, Artificial Sequence
  Synthetic oligonucleotide
caaugaagucauaggaagagggcat

SEQ ID NO: 232 - DNA, 25 bp, Artificial Sequence
  Synthetic oligonucleotide
aaugaagucauaggaagagggcatt

SEQ ID NO: 233 - DNA, 25 bp, Artificial Sequence
  Synthetic oligonucleotide
augaagucauaggaagagggcautt

SEQ ID NO: 234 - DNA, 25 bp, Artificial Sequence
  Synthetic oligonucleotide
ugaagucauaggaagagggcauutt

SEQ ID NO: 235 - DNA, 25 bp, Artificial Sequence
  Synthetic oligonucleotide
gaagucauaggaagagggcauuutg

SEQ ID NO: 236 - DNA, 25 bp, Artificial Sequence
  Synthetic oligonucleotide
aagucauaggaagagggcauuuugg

SEQ ID NO: 237 - DNA, 25 bp, Artificial Sequence
  Synthetic oligonucleotide
agucauaggaagagggcauuuuggt

SEQ ID NO: 238 - DNA, 25 bp, Artificial Sequence
  Synthetic oligonucleotide
gucauaggaagagggcauuuuggtt

SEQ ID NO: 239 - DNA, 25 bp, Artificial Sequence
  Synthetic oligonucleotide
ucauaggaagagggcauuuuggutg

SEQ ID NO: 240 - DNA, 25 bp, Artificial Sequence
  Synthetic oligonucleotide
cauaggaagagggcauuuugguugt

SEQ ID NO: 241 - DNA, 25 bp, Artificial Sequence
  Synthetic oligonucleotide
auaggaagagggcauuuugguugtg

SEQ ID NO: 242 - DNA, 25 bp, Artificial Sequence
  Synthetic oligonucleotide
aagaaaauucacugugcugugaaat

SEQ ID NO: 243 - DNA, 25 bp, Artificial Sequence
  Synthetic oligonucleotide
agaaaauucacugugcugugaaatc

SEQ ID NO: 244 - DNA, 25 bp, Artificial Sequence
  Synthetic oligonucleotide
gaaaauucacugugcugugaaaucc

SEQ ID NO: 245 - DNA, 25 bp, Artificial Sequence
  Synthetic oligonucleotide
aaaauucacugugcugugaaaucct

SEQ ID NO: 246 - DNA, 25 bp, Artificial Sequence
  Synthetic oligonucleotide
aaauucacugugcugugaaaucctt

SEQ ID NO: 247 - DNA, 25 bp, Artificial Sequence
  Synthetic oligonucleotide
aauucacugugcugugaaauccutg

SEQ ID NO: 248 - DNA, 25 bp, Artificial Sequence
  Synthetic oligonucleotide
auucacugugcugugaaauccuuga

SEQ ID NO: 249 - DNA, 25 bp, Artificial Sequence
  Synthetic oligonucleotide
uucacugugcugugaaauccuugaa

SEQ ID NO: 250 - DNA, 25 bp, Artificial Sequence
  Synthetic oligonucleotide
ucacugugcugugaaauccuugaac

SEQ ID NO: 251 - DNA, 25 bp, Artificial Sequence
  Synthetic oligonucleotide
cacugugcugugaaauccuugaaca

SEQ ID NO: 252 - DNA, 25 bp, Artificial Sequence
  Synthetic oligonucleotide
acugugcugugaaauccuugaacag

SEQ ID NO: 253 - DNA, 25 bp, Artificial Sequence
  Synthetic oligonucleotide
gagggaaucaucaugaaagauuuta

SEQ ID NO: 254 - DNA, 25 bp, Artificial Sequence
  Synthetic oligonucleotide
agggaaucaucaugaaagauuuuag

SEQ ID NO: 255 - DNA, 25 bp, Artificial Sequence
  Synthetic oligonucleotide
gagacucauaauccaacuguaaaag

SEQ ID NO: 256 - DNA, 25 bp, Artificial Sequence
  Synthetic oligonucleotide
agacucauaauccaacuguaaaaga

SEQ ID NO: 257 - DNA, 25 bp, Artificial Sequence
  Synthetic oligonucleotide
cuguaaaagaucuuauuggcuuugg

SEQ ID NO: 258 - DNA, 25 bp, Artificial Sequence
  Synthetic oligonucleotide
ggcuuuggucuucaaguagccaaag

SEQ ID NO: 259 - DNA, 25 bp, Artificial Sequence
  Synthetic oligonucleotide
cuucaaguagccaaaggcaugaaat

SEQ ID NO: 260 - DNA, 25 bp, Artificial Sequence
  Synthetic oligonucleotide
uucaaguagccaaaggcaugaaata

SEQ ID NO: 261 - DNA, 25 bp, Artificial Sequence
  Synthetic oligonucleotide
ucaaguagccaaaggcaugaaauat

SEQ ID NO: 262 - DNA, 25 bp, Artificial Sequence
  Synthetic oligonucleotide
caaguagccaaaggcaugaaauatc

SEQ ID NO: 263 - DNA, 25 bp, Artificial Sequence
  Synthetic oligonucleotide
aaguagccaaaggcaugaaauauct

SEQ ID NO: 264 - DNA, 25 bp, Artificial Sequence
  Synthetic oligonucleotide
aguagccaaaggcaugaaauauctt

SEQ ID NO: 265 - DNA, 25 bp, Artificial Sequence
  Synthetic oligonucleotide
guagccaaaggcaugaaauaucutg

SEQ ID NO: 266 - DNA, 25 bp, Artificial Sequence
  Synthetic oligonucleotide
uagccaaaggcaugaaauaucuugc

SEQ ID NO: 267 - DNA, 25 bp, Artificial Sequence
  Synthetic oligonucleotide
agccaaaggcaugaaauaucuugca

SEQ ID NO: 268 - DNA, 25 bp, Artificial Sequence
  Synthetic oligonucleotide
gccaaaggcaugaaauaucuugcaa

SEQ ID NO: 269 - DNA, 25 bp, Artificial Sequence
  Synthetic oligonucleotide
ccaaaggcaugaaauaucuugcaag

SEQ ID NO: 270 - DNA, 25 bp, Artificial Sequence
  Synthetic oligonucleotide
caaaggcaugaaauaucuugcaagc

SEQ ID NO: 271 - DNA, 25 bp, Artificial Sequence
  Synthetic oligonucleotide
aaaggcaugaaauaucuugcaagca

SEQ ID NO: 272 - DNA, 25 bp, Artificial Sequence
  Synthetic oligonucleotide
aaggcaugaaauaucuugcaagcaa

SEQ ID NO: 273 - DNA, 25 bp, Artificial Sequence
  Synthetic oligonucleotide
agcaaaaaguuuguccacagagact

SEQ ID NO: 274 - DNA, 25 bp, Artificial Sequence
  Synthetic oligonucleotide
gcaaaaaguuuguccacagagactt

SEQ ID NO: 275 - DNA, 25 bp, Artificial Sequence
  Synthetic oligonucleotide
caaaaaguuuguccacagagacutg

SEQ ID NO: 276 - DNA, 25 bp, Artificial Sequence
  Synthetic oligonucleotide
aaaaaguuuguccacagagacuugg

SEQ ID NO: 277 - DNA, 25 bp, Artificial Sequence
  Synthetic oligonucleotide
aaaaguuuguccacagagacuuggc

SEQ ID NO: 278 - DNA, 25 bp, Artificial Sequence
  Synthetic oligonucleotide
aaaguuuguccacagagacuuggct

SEQ ID NO: 279 - DNA, 25 bp, Artificial Sequence
  Synthetic oligonucleotide
aaguuuguccacagagacuuggctg

SEQ ID NO: 280 - DNA, 25 bp, Artificial Sequence
  Synthetic oligonucleotide
aguuuguccacagagacuuggcugc

SEQ ID NO: 281 - DNA, 25 bp, Artificial Sequence
  Synthetic oligonucleotide
cuuggcugcaagaaacuguaugctg

SEQ ID NO: 282 - DNA, 25 bp, Artificial Sequence
  Synthetic oligonucleotide
uggcugcaagaaacuguaugcugga

SEQ ID NO: 283 - DNA, 25 bp, Artificial Sequence
  Synthetic oligonucleotide
ggcugcaagaaacuguaugcuggat

SEQ ID NO: 284 - DNA, 25 bp, Artificial Sequence
  Synthetic oligonucleotide
gcugcaagaaacuguaugcuggatg

SEQ ID NO: 285 - DNA, 25 bp, Artificial Sequence
  Synthetic oligonucleotide
cugcaagaaacuguaugcuggauga

SEQ ID NO: 286 - DNA, 25 bp, Artificial Sequence
  Synthetic oligonucleotide
gucaagguugcugauuuuggucutg

SEQ ID NO: 287 - DNA, 25 bp, Artificial Sequence
  Synthetic oligonucleotide
gguugcugauuuuggucuugccaga

SEQ ID NO: 288 - DNA, 25 bp, Artificial Sequence
  Synthetic oligonucleotide
uugcugauuuuggucuugccagaga

SEQ ID NO: 289 - DNA, 25 bp, Artificial Sequence
  Synthetic oligonucleotide
ggucuugccagagacauguaugata

SEQ ID NO: 290 - DNA, 25 bp, Artificial Sequence
  Synthetic oligonucleotide
gucuugccagagacauguaugauaa

SEQ ID NO: 291 - DNA, 25 bp, Artificial Sequence
  Synthetic oligonucleotide
gcugccagugaaguggauggcuutg

SEQ ID NO: 292 - DNA, 25 bp, Artificial Sequence
  Synthetic oligonucleotide
cugccagugaaguggauggcuuugg

SEQ ID NO: 293 - DNA, 25 bp, Artificial Sequence
  Synthetic oligonucleotide
guggauggcuuuggaaagucugcaa

SEQ ID NO: 294 - DNA, 25 bp, Artificial Sequence
  Synthetic oligonucleotide
ggauggcuuuggaaagucugcaaac

SEQ ID NO: 295 - DNA, 25 bp, Artificial Sequence
  Synthetic oligonucleotide
uuuggaaagucugcaaacucaaaag

SEQ ID NO: 296 - DNA, 25 bp, Artificial Sequence
  Synthetic oligonucleotide
cuuuggcgugcuccucugggagctg

SEQ ID NO: 297 - DNA, 25 bp, Artificial Sequence
  Synthetic oligonucleotide
uuggcgugcuccucugggagcugat

SEQ ID NO: 298 - DNA, 25 bp, Artificial Sequence
  Synthetic oligonucleotide
uggcgugcuccucugggagcugatg

SEQ ID NO: 299 - DNA, 25 bp, Artificial Sequence
  Synthetic oligonucleotide
ggcgugcuccucugggagcugauga

SEQ ID NO: 300 - DNA, 25 bp, Artificial Sequence
  Synthetic oligonucleotide
gcgugcuccucugggagcugaugac

SEQ ID NO: 301 - DNA, 25 bp, Artificial Sequence
  Synthetic oligonucleotide
gugaacgcuacuuaugugaacguaa

SEQ ID NO: 302 - DNA, 25 bp, Artificial Sequence
  Synthetic oligonucleotide
ugaacgcuacuuaugugaacguaaa

SEQ ID NO: 303 - DNA, 25 bp, Artificial Sequence
  Synthetic oligonucleotide
cuguugucaucagaagauaacgctg

SEQ ID NO: 304 - DNA, 25 bp, Artificial Sequence
  Synthetic oligonucleotide
uugcucuugccaaaauugcacuatt

SEQ ID NO: 305 - DNA, 25 bp, Artificial Sequence
  Synthetic oligonucleotide
auuguuauuuaaauuacuggauuct

SEQ ID NO: 306 - DNA, 25 bp, Artificial Sequence
  Synthetic oligonucleotide
cuggauucuaaggaauuucuuauct

SEQ ID NO: 307 - DNA, 25 bp, Artificial Sequence
  Synthetic oligonucleotide
uggauucuaaggaauuucuuauctg

SEQ ID NO: 308 - DNA, 25 bp, Artificial Sequence
  Synthetic oligonucleotide
gguugaauuuuuuaaaaaucaggta

SEQ ID NO: 309 - DNA, 25 bp, Artificial Sequence
  Synthetic oligonucleotide
aaacauucccuuuuaaauguuugtt

SEQ ID NO: 310 - DNA, 25 bp, Artificial Sequence
  Synthetic oligonucleotide
uuaaauguuuguuuguuuuuugaga

SEQ ID NO: 311 - DNA, 25 bp, Artificial Sequence
  Synthetic oligonucleotide
ggaucucacucuguugccagggctg

SEQ ID NO: 312 - DNA, 25 bp, Artificial Sequence
  Synthetic oligonucleotide
aucucacucuguugccagggcugta

SEQ ID NO: 313 - DNA, 25 bp, Artificial Sequence
  Synthetic oligonucleotide
cacucuguugccagggcuguagugc

SEQ ID NO: 314 - DNA, 25 bp, Artificial Sequence
  Synthetic oligonucleotide
cucuguugccagggcuguagugcag

SEQ ID NO: 315 - DNA, 25 bp, Artificial Sequence
  Synthetic oligonucleotide
guugccagggcuguagugcaguggt

SEQ ID NO: 316 - DNA, 25 bp, Artificial Sequence
  Synthetic oligonucleotide
cuguagugcaguggugugaucauag

SEQ ID NO: 317 - DNA, 25 bp, Artificial Sequence
  Synthetic oligonucleotide
gcaguggugugaucauagcucactg

SEQ ID NO: 318 - DNA, 25 bp, Artificial Sequence
  Synthetic oligonucleotide
ggcuaauuuuuguauuuuuuguaga

SEQ ID NO: 319 - DNA, 25 bp, Artificial Sequence
  Synthetic oligonucleotide
uuauaaauuuuuguauagacauucc

SEQ ID NO: 320 - DNA, 25 bp, Artificial Sequence
  Synthetic oligonucleotide
uggaagaauauuuauaggcaauaca

SEQ ID NO: 321 - DNA, 25 bp, Artificial Sequence
  Synthetic oligonucleotide
cacaaaacauguuuauaaaugaaca

SEQ ID NO: 322 - DNA, 25 bp, Artificial Sequence
  Synthetic oligonucleotide
gacauuaagaaaauuuguaugaaat

SEQ ID NO: 323 - DNA, 25 bp, Artificial Sequence
  Synthetic oligonucleotide
guguguauuuuuuuaaaugaaaact

SEQ ID NO: 324 - DNA, 25 bp, Artificial Sequence
  Synthetic oligonucleotide
cucagcauguuuguaaagcaggata

SEQ ID NO: 325 - DNA, 25 bp, Artificial Sequence
  Synthetic oligonucleotide
gauggauugaaaagauuagccuctg

SEQ ID NO: 326 - DNA, 25 bp, Artificial Sequence
  Synthetic oligonucleotide
ucuguggaauuuugugcuugcuact

SEQ ID NO: 327 - DNA, 25 bp, Artificial Sequence
  Synthetic oligonucleotide
cuguggaauuuugugcuugcuactg

SEQ ID NO: 328 - DNA, 25 bp, Artificial Sequence
  Synthetic oligonucleotide
guggaauuuugugcuugcuacugta

SEQ ID NO: 329 - DNA, 25 bp, Artificial Sequence
  Synthetic oligonucleotide
gaauuuugugcuugcuacuguauag

SEQ ID NO: 330 - DNA, 25 bp, Artificial Sequence
  Synthetic oligonucleotide
uuuugugcuugcuacuguauagugc

SEQ ID NO: 331 - DNA, 25 bp, Artificial Sequence
  Synthetic oligonucleotide
uugugcuugcuacuguauagugcat

SEQ ID NO: 332 - DNA, 25 bp, Artificial Sequence
  Synthetic oligonucleotide
ugugcuugcuacuguauagugcatg

SEQ ID NO: 333 - DNA, 25 bp, Artificial Sequence
  Synthetic oligonucleotide
gugcuugcuacuguauagugcaugt

SEQ ID NO: 334 - DNA, 25 bp, Artificial Sequence
  Synthetic oligonucleotide
ugcuugcuacuguauagugcaugtg

SEQ ID NO: 335 - DNA, 25 bp, Artificial Sequence
  Synthetic oligonucleotide
gcuugcuacuguauagugcaugugg

SEQ ID NO: 336 - DNA, 25 bp, Artificial Sequence
  Synthetic oligonucleotide
uugcuacuguauagugcauguggtg

SEQ ID NO: 337 - DNA, 25 bp, Artificial Sequence
  Synthetic oligonucleotide
gcuacuguauagugcauguggugta

SEQ ID NO: 338 - DNA, 25 bp, Artificial Sequence
  Synthetic oligonucleotide
cuacuguauagugcaugugguguag

SEQ ID NO: 339 - DNA, 25 bp, Artificial Sequence
  Synthetic oligonucleotide
uacuguauagugcaugugguguagg

SEQ ID NO: 340 - DNA, 25 bp, Artificial Sequence
  Synthetic oligonucleotide
aacauuuaaaguguuauauuuuuta

SEQ ID NO: 341 - DNA, 25 bp, Artificial Sequence
  Synthetic oligonucleotide
aaaauguuuauuuuuaaugauauga

SEQ ID NO: 342 - DNA, 25 bp, Artificial Sequence
  Synthetic oligonucleotide
aaauguuuauuuuuaaugauaugag

SEQ ID NO: 343 - DNA, 25 bp, Artificial Sequence
  Synthetic oligonucleotide
aauguuuauuuuuaaugauaugaga

SEQ ID NO: 344 - DNA, 25 bp, Artificial Sequence
  Synthetic oligonucleotide
acugugaacauuuuagaaaagguat

SEQ ID NO: 345 - DNA, 25 bp, Artificial Sequence
  Synthetic oligonucleotide
gauaaggaaauguacugauugccaa

SEQ ID NO: 346 - DNA, 25 bp, Artificial Sequence
  Synthetic oligonucleotide
auaaggaaauguacugauugccaat

SEQ ID NO: 347 - DNA, 25 bp, Artificial Sequence
  Synthetic oligonucleotide
uaaggaaauguacugauugccaata

SEQ ID NO: 348 - DNA, 25 bp, Artificial Sequence
  Synthetic oligonucleotide
aaggaaauguacugauugccaauac

SEQ ID NO: 349 - DNA, 25 bp, Artificial Sequence
  Synthetic oligonucleotide
aggaaauguacugauugccaauaca

SEQ ID NO: 350 - DNA, 25 bp, Artificial Sequence
  Synthetic oligonucleotide
ggaaauguacugauugccaauacac

SEQ ID NO: 351 - DNA, 25 bp, Artificial Sequence
  Synthetic oligonucleotide
caggacuugaagccaaggguuaacc

SEQ ID NO: 352 - DNA, 25 bp, Artificial Sequence
  Synthetic oligonucleotide
aggacuugaagccaaggguuaaccc

SEQ ID NO: 353 - DNA, 25 bp, Artificial Sequence
  Synthetic oligonucleotide
ggacuugaagccaaggguuaaccca

SEQ ID NO: 354 - DNA, 25 bp, Artificial Sequence
  Synthetic oligonucleotide
gacuugaagccaaggguuaacccag

SEQ ID NO: 355 - DNA, 25 bp, Artificial Sequence
  Synthetic oligonucleotide
acuugaagccaaggguuaacccagc

SEQ ID NO: 356 - DNA, 25 bp, Artificial Sequence
  Synthetic oligonucleotide
ccguuucauaaauguaauaaguaat

SEQ ID NO: 357 - DNA, 25 bp, Artificial Sequence
  Synthetic oligonucleotide
ugcuauuuauaaacuuguccuuaga

SEQ ID NO: 358 - DNA, 25 bp, Artificial Sequence
  Synthetic oligonucleotide
uugucacugccuauaccugcagctg

SEQ ID NO: 359 - DNA, 25 bp, Artificial Sequence
  Synthetic oligonucleotide
ugucacugccuauaccugcagcuga

SEQ ID NO: 360 - DNA, 25 bp, Artificial Sequence
  Synthetic oligonucleotide
gucacugccuauaccugcagcugaa

SEQ ID NO: 361 - RNA, 27 nt, Artificial Sequence
  Synthetic oligonucleotide
gcaaggaccacacgcgcgcuccgcgcc

SEQ ID NO: 362 - RNA, 27 nt, Artificial Sequence
  Synthetic oligonucleotide
cgcaaggaccacacgcgcgcuccgcgc

SEQ ID NO: 363 - RNA, 27 nt, Artificial Sequence
  Synthetic oligonucleotide
gcgcaaggaccacacgcgcgcuccgcg

SEQ ID NO: 364 - RNA, 27 nt, Artificial Sequence
  Synthetic oligonucleotide
cggcgcaaggaccacacgcgcgcuccg

SEQ ID NO: 365 - RNA, 27 nt, Artificial Sequence
  Synthetic oligonucleotide
agcggcgcaaggaccacacgcgcgcuc

SEQ ID NO: 366 - RNA, 27 nt, Artificial Sequence
  Synthetic oligonucleotide
cagcggcgcaaggaccacacgcgcgcu

SEQ ID NO: 367 - RNA, 27 nt, Artificial Sequence
  Synthetic oligonucleotide
gucagcggcgcaaggaccacacgcgcg

SEQ ID NO: 368 - RNA, 27 nt, Artificial Sequence
  Synthetic oligonucleotide
agucagcggcgcaaggaccacacgcgc

SEQ ID NO: 369 - RNA, 27 nt, Artificial Sequence
  Synthetic oligonucleotide
gaagucagcggcgcaaggaccacacgc

SEQ ID NO: 370 - RNA, 27 nt, Artificial Sequence
  Synthetic oligonucleotide
caguggagaagucagcggcgcaaggac

SEQ ID NO: 371 - RNA, 27 nt, Artificial Sequence
  Synthetic oligonucleotide
gaaccaguggagaagucagcggcgcaa

SEQ ID NO: 372 - RNA, 27 nt, Artificial Sequence
  Synthetic oligonucleotide
acgaggaugccaggugcaagcacagcg

SEQ ID NO: 373 - RNA, 27 nt, Artificial Sequence
  Synthetic oligonucleotide
gcacgaggaugccaggugcaagcacag

SEQ ID NO: 374 - RNA, 27 nt, Artificial Sequence
  Synthetic oligonucleotide
aacaggagcacgaggaugccaggugca

SEQ ID NO: 375 - RNA, 27 nt, Artificial Sequence
  Synthetic oligonucleotide
gcaccaagguaaacaggagcacgagga

SEQ ID NO: 376 - RNA, 27 nt, Artificial Sequence
  Synthetic oligonucleotide
ucugcaccaagguaaacaggagcacga

SEQ ID NO: 377 - RNA, 27 nt, Artificial Sequence
  Synthetic oligonucleotide
cucugcaccaagguaaacaggagcacg

SEQ ID NO: 378 - RNA, 27 nt, Artificial Sequence
  Synthetic oligonucleotide
auuuaaaacauaaauguaguuaguggc

SEQ ID NO: 379 - RNA, 27 nt, Artificial Sequence
  Synthetic oligonucleotide
ccucauuuaaaacauaaauguaguuag

SEQ ID NO: 380 - RNA, 27 nt, Artificial Sequence
  Synthetic oligonucleotide
uccucauuuaaaacauaaauguaguua

SEQ ID NO: 381 - RNA, 27 nt, Artificial Sequence
  Synthetic oligonucleotide
uuccucauuuaaaacauaaauguaguu

SEQ ID NO: 382 - RNA, 27 nt, Artificial Sequence
  Synthetic oligonucleotide
cuuccucauuuaaaacauaaauguagu

SEQ ID NO: 383 - RNA, 27 nt, Artificial Sequence
  Synthetic oligonucleotide
ucuuccucauuuaaaacauaaauguag

SEQ ID NO: 384 - RNA, 27 nt, Artificial Sequence
  Synthetic oligonucleotide
caugggaaacaaucuggguguuccagc

SEQ ID NO: 385 - RNA, 27 nt, Artificial Sequence
  Synthetic oligonucleotide
uaaauuggcuuugcugcugcaguccug

SEQ ID NO: 386 - RNA, 27 nt, Artificial Sequence
  Synthetic oligonucleotide
auaaauuggcuuugcugcugcaguccu

SEQ ID NO: 387 - RNA, 27 nt, Artificial Sequence
  Synthetic oligonucleotide
gauaaauuggcuuugcugcugcagucc

SEQ ID NO: 388 - RNA, 27 nt, Artificial Sequence
  Synthetic oligonucleotide
ugauaaauuggcuuugcugcugcaguc

SEQ ID NO: 389 - RNA, 27 nt, Artificial Sequence
  Synthetic oligonucleotide
cugauaaauuggcuuugcugcugcagu

SEQ ID NO: 390 - RNA, 27 nt, Artificial Sequence
  Synthetic oligonucleotide
agcuaaugaguugaucaucauaguagg

SEQ ID NO: 391 - RNA, 27 nt, Artificial Sequence
  Synthetic oligonucleotide
cagcuaaugaguugaucaucauaguag

SEQ ID NO: 392 - RNA, 27 nt, Artificial Sequence
  Synthetic oligonucleotide
acagcuaaugaguugaucaucauagua

SEQ ID NO: 393 - RNA, 27 nt, Artificial Sequence
  Synthetic oligonucleotide
cacagcuaaugaguugaucaucauagu

SEQ ID NO: 394 - RNA, 27 nt, Artificial Sequence
  Synthetic oligonucleotide
ccacagcuaaugaguugaucaucauag

SEQ ID NO: 395 - RNA, 27 nt, Artificial Sequence
  Synthetic oligonucleotide
gccacagcuaaugaguugaucaucaua

SEQ ID NO: 396 - RNA, 27 nt, Artificial Sequence
  Synthetic oligonucleotide
ugccacagcuaaugaguugaucaucau

SEQ ID NO: 397 - RNA, 27 nt, Artificial Sequence
  Synthetic oligonucleotide
cugccacagcuaaugaguugaucauca

SEQ ID NO: 398 - RNA, 27 nt, Artificial Sequence
  Synthetic oligonucleotide
gcugccacagcuaaugaguugaucauc

SEQ ID NO: 399 - RNA, 27 nt, Artificial Sequence
  Synthetic oligonucleotide
cgcugccacagcuaaugaguugaucau

SEQ ID NO: 400 - RNA, 27 nt, Artificial Sequence
  Synthetic oligonucleotide
acgcugccacagcuaaugaguugauca

SEQ ID NO: 401 - RNA, 27 nt, Artificial Sequence
  Synthetic oligonucleotide
gacgcugccacagcuaaugaguugauc

SEQ ID NO: 402 - RNA, 27 nt, Artificial Sequence
  Synthetic oligonucleotide
ugacgcugccacagcuaaugaguugau

SEQ ID NO: 403 - RNA, 27 nt, Artificial Sequence
  Synthetic oligonucleotide
uugacgcugccacagcuaaugaguuga

SEQ ID NO: 404 - RNA, 27 nt, Artificial Sequence
  Synthetic oligonucleotide
gguccgucaaaaacauaaaaccaucuu

SEQ ID NO: 405 - RNA, 27 nt, Artificial Sequence
  Synthetic oligonucleotide
guaaauaaaauuguugcuuucaaaggc

SEQ ID NO: 406 - RNA, 27 nt, Artificial Sequence
  Synthetic oligonucleotide
aaaagucugagcaucuagaguuucccu

SEQ ID NO: 407 - RNA, 27 nt, Artificial Sequence
  Synthetic oligonucleotide
gaaaagucugagcaucuagaguuuccc

SEQ ID NO: 408 - RNA, 27 nt, Artificial Sequence
  Synthetic oligonucleotide
ugaaaagucugagcaucuagaguuucc

SEQ ID NO: 409 - RNA, 27 nt, Artificial Sequence
  Synthetic oligonucleotide
gugaaaagucugagcaucuagaguuuc

SEQ ID NO: 410 - RNA, 27 nt, Artificial Sequence
  Synthetic oligonucleotide
ugugaaaagucugagcaucuagaguuu

SEQ ID NO: 411 - RNA, 27 nt, Artificial Sequence
  Synthetic oligonucleotide
gugugaaaagucugagcaucuagaguu

SEQ ID NO: 412 - RNA, 27 nt, Artificial Sequence
  Synthetic oligonucleotide
ggaacagaaccugauuauucuugugug

SEQ ID NO: 413 - RNA, 27 nt, Artificial Sequence
  Synthetic oligonucleotide
auggaacagaaccugauuauucuugug

SEQ ID NO: 414 - RNA, 27 nt, Artificial Sequence
  Synthetic oligonucleotide
uauggaacagaaccugauuauucuugu

SEQ ID NO: 415 - RNA, 27 nt, Artificial Sequence
  Synthetic oligonucleotide
uuauggaacagaaccugauuauucuug

SEQ ID NO: 416 - RNA, 27 nt, Artificial Sequence
  Synthetic oligonucleotide
uuuauggaacagaaccugauuauucuu

SEQ ID NO: 417 - RNA, 27 nt, Artificial Sequence
  Synthetic oligonucleotide
guuuauggaacagaaccugauuauucu

SEQ ID NO: 418 - RNA, 27 nt, Artificial Sequence
  Synthetic oligonucleotide
gaaugcaauccagaguuuauggaacag

SEQ ID NO: 419 - RNA, 27 nt, Artificial Sequence
  Synthetic oligonucleotide
ucucuuuucugugagaauacacuccag

SEQ ID NO: 420 - RNA, 27 nt, Artificial Sequence
  Synthetic oligonucleotide
agccugaaguauauuaaacacuuccuu

SEQ ID NO: 421 - RNA, 27 nt, Artificial Sequence
  Synthetic oligonucleotide
caggcuugcugacauacgcagccugaa

SEQ ID NO: 422 - RNA, 27 nt, Artificial Sequence
  Synthetic oligonucleotide
cggcagaaucuggcuugcuuugugcga

SEQ ID NO: 423 - RNA, 27 nt, Artificial Sequence
  Synthetic oligonucleotide
ucggcagaaucuggcuugcuuugugcg

SEQ ID NO: 424 - RNA, 27 nt, Artificial Sequence
  Synthetic oligonucleotide
uucggcagaaucuggcuugcuuugugc

SEQ ID NO: 425 - RNA, 27 nt, Artificial Sequence
  Synthetic oligonucleotide
guucggcagaaucuggcuugcuuugug

SEQ ID NO: 426 - RNA, 27 nt, Artificial Sequence
  Synthetic oligonucleotide
gguucggcagaaucuggcuugcuuugu

SEQ ID NO: 427 - RNA, 27 nt, Artificial Sequence
  Synthetic oligonucleotide
cguaaaaaugcuggagacaucucacau

SEQ ID NO: 428 - RNA, 27 nt, Artificial Sequence
  Synthetic oligonucleotide
ccguaaaaaugcuggagacaucucaca

SEQ ID NO: 429 - RNA, 27 nt, Artificial Sequence
  Synthetic oligonucleotide
uccguaaaaaugcuggagacaucucac

SEQ ID NO: 430 - RNA, 27 nt, Artificial Sequence
  Synthetic oligonucleotide
guccguaaaaaugcuggagacaucuca

SEQ ID NO: 431 - RNA, 27 nt, Artificial Sequence
  Synthetic oligonucleotide
gguccguaaaaaugcuggagacaucuc

SEQ ID NO: 432 - RNA, 27 nt, Artificial Sequence
  Synthetic oligonucleotide
ggguccguaaaaaugcuggagacaucu

SEQ ID NO: 433 - RNA, 27 nt, Artificial Sequence
  Synthetic oligonucleotide
uggguccguaaaaaugcuggagacauc

SEQ ID NO: 434 - RNA, 27 nt, Artificial Sequence
  Synthetic oligonucleotide
uuggguccguaaaaaugcuggagacau

SEQ ID NO: 435 - RNA, 27 nt, Artificial Sequence
  Synthetic oligonucleotide
auuggguccguaaaaaugcuggagaca

SEQ ID NO: 436 - RNA, 27 nt, Artificial Sequence
  Synthetic oligonucleotide
gauuggguccguaaaaaugcuggagac

SEQ ID NO: 437 - RNA, 27 nt, Artificial Sequence
  Synthetic oligonucleotide
ugauuggguccguaaaaaugcuggaga

SEQ ID NO: 438 - RNA, 27 nt, Artificial Sequence
  Synthetic oligonucleotide
augauuggguccguaaaaaugcuggag

SEQ ID NO: 439 - RNA, 27 nt, Artificial Sequence
  Synthetic oligonucleotide
caugauuggguccguaaaaaugcugga

SEQ ID NO: 440 - RNA, 27 nt, Artificial Sequence
  Synthetic oligonucleotide
ucaugauuggguccguaaaaaugcugg

SEQ ID NO: 441 - RNA, 27 nt, Artificial Sequence
  Synthetic oligonucleotide
caacgcgcugcaaagcugugguaaacu

SEQ ID NO: 442 - RNA, 27 nt, Artificial Sequence
  Synthetic oligonucleotide
gucaacgcgcugcaaagcugugguaaa

SEQ ID NO: 443 - RNA, 27 nt, Artificial Sequence
  Synthetic oligonucleotide
aagucaacgcgcugcaaagcuguggua

SEQ ID NO: 444 - RNA, 27 nt, Artificial Sequence
  Synthetic oligonucleotide
uaagucaacgcgcugcaaagcuguggu

SEQ ID NO: 445 - RNA, 27 nt, Artificial Sequence
  Synthetic oligonucleotide
aauaagucaacgcgcugcaaagcugug

SEQ ID NO: 446 - RNA, 27 nt, Artificial Sequence
  Synthetic oligonucleotide
ugaauaagucaacgcgcugcaaagcug

SEQ ID NO: 447 - RNA, 27 nt, Artificial Sequence
  Synthetic oligonucleotide
augaauaagucaacgcgcugcaaagcu

SEQ ID NO: 448 - RNA, 27 nt, Artificial Sequence
  Synthetic oligonucleotide
caugaauaagucaacgcgcugcaaagc

SEQ ID NO: 449 - RNA, 27 nt, Artificial Sequence
  Synthetic oligonucleotide
ccaugaauaagucaacgcgcugcaaag

SEQ ID NO: 450 - RNA, 27 nt, Artificial Sequence
  Synthetic oligonucleotide
ccaaagucccagccacauauggucagc

SEQ ID NO: 451 - RNA, 27 nt, Artificial Sequence
  Synthetic oligonucleotide
uccaaagucccagccacauauggucag

SEQ ID NO: 452 - RNA, 27 nt, Artificial Sequence
  Synthetic oligonucleotide
auccaaagucccagccacauaugguca

SEQ ID NO: 453 - RNA, 27 nt, Artificial Sequence
  Synthetic oligonucleotide
aauccaaagucccagccacauaugguc

SEQ ID NO: 454 - RNA, 27 nt, Artificial Sequence
  Synthetic oligonucleotide
aaauccaaagucccagccacauauggu

SEQ ID NO: 455 - RNA, 27 nt, Artificial Sequence
  Synthetic oligonucleotide
gaaauccaaagucccagccacauaugg

SEQ ID NO: 456 - RNA, 27 nt, Artificial Sequence
  Synthetic oligonucleotide
cgaaauccaaagucccagccacauaug

SEQ ID NO: 457 - RNA, 27 nt, Artificial Sequence
  Synthetic oligonucleotide
ccgaaauccaaagucccagccacauau

SEQ ID NO: 458 - RNA, 27 nt, Artificial Sequence
  Synthetic oligonucleotide
uccgaaauccaaagucccagccacaua

SEQ ID NO: 459 - RNA, 27 nt, Artificial Sequence
  Synthetic oligonucleotide
cuccgaaauccaaagucccagccacau

SEQ ID NO: 460 - RNA, 27 nt, Artificial Sequence
  Synthetic oligonucleotide
uuaaaucaaauuuauuauuccuccgaa

SEQ ID NO: 461 - RNA, 27 nt, Artificial Sequence
  Synthetic oligonucleotide
uuucuuuaaaucaaauuuauuauuccu

SEQ ID NO: 462 - RNA, 27 nt, Artificial Sequence
  Synthetic oligonucleotide
uuuucuuuaaaucaaauuuauuauucc

SEQ ID NO: 463 - RNA, 27 nt, Artificial Sequence
  Synthetic oligonucleotide
uggcaggaccaacugugcauuucaaug

SEQ ID NO: 464 - RNA, 27 nt, Artificial Sequence
  Synthetic oligonucleotide
auggcaggaccaacugugcauuucaau

SEQ ID NO: 465 - RNA, 27 nt, Artificial Sequence
  Synthetic oligonucleotide
auuugaaauaauuauggacauauugaa

SEQ ID NO: 466 - RNA, 27 nt, Artificial Sequence
  Synthetic oligonucleotide
acuuuuuaaaguacauguuuuuccacc

SEQ ID NO: 467 - RNA, 27 nt, Artificial Sequence
  Synthetic oligonucleotide
cagcuguugcagggaaggagugguaca

SEQ ID NO: 468 - RNA, 27 nt, Artificial Sequence
  Synthetic oligonucleotide
aucaucacuggcuuuucaaaaggcuua

SEQ ID NO: 469 - RNA, 27 nt, Artificial Sequence
  Synthetic oligonucleotide
ccuuuaacugcuucagggucaauauca

SEQ ID NO: 470 - RNA, 27 nt, Artificial Sequence
  Synthetic oligonucleotide
accuuuaacugcuucagggucaauauc

SEQ ID NO: 471 - RNA, 27 nt, Artificial Sequence
  Synthetic oligonucleotide
caccuuuaacugcuucagggucaauau

SEQ ID NO: 472 - RNA, 27 nt, Artificial Sequence
  Synthetic oligonucleotide
ucaccuuuaacugcuucagggucaaua

SEQ ID NO: 473 - RNA, 27 nt, Artificial Sequence
  Synthetic oligonucleotide
uucaccuuuaacugcuucagggucaau

SEQ ID NO: 474 - RNA, 27 nt, Artificial Sequence
  Synthetic oligonucleotide
cuucaccuuuaacugcuucagggucaa

SEQ ID NO: 475 - RNA, 27 nt, Artificial Sequence
  Synthetic oligonucleotide
acuucaccuuuaacugcuucaggguca

SEQ ID NO: 476 - RNA, 27 nt, Artificial Sequence
  Synthetic oligonucleotide
cacuucaccuuuaacugcuucaggguc

SEQ ID NO: 477 - RNA, 27 nt, Artificial Sequence
  Synthetic oligonucleotide
acacuucaccuuuaacugcuucagggu

SEQ ID NO: 478 - RNA, 27 nt, Artificial Sequence
  Synthetic oligonucleotide
aacacuucaccuuuaacugcuucaggg

SEQ ID NO: 479 - RNA, 27 nt, Artificial Sequence
  Synthetic oligonucleotide
uaacacuucaccuuuaacugcuucagg

SEQ ID NO: 480 - RNA, 27 nt, Artificial Sequence
  Synthetic oligonucleotide
uuaacacuucaccuuuaacugcuucag

SEQ ID NO: 481 - RNA, 27 nt, Artificial Sequence
  Synthetic oligonucleotide
uuuaacacuucaccuuuaacugcuuca

SEQ ID NO: 482 - RNA, 27 nt, Artificial Sequence
  Synthetic oligonucleotide
uuuuaacacuucaccuuuaacugcuuc

SEQ ID NO: 483 - RNA, 27 nt, Artificial Sequence
  Synthetic oligonucleotide
cuuuuaacacuucaccuuuaacugcuu

SEQ ID NO: 484 - RNA, 27 nt, Artificial Sequence
  Synthetic oligonucleotide
acuuuuaacacuucaccuuuaacugcu

SEQ ID NO: 485 - RNA, 27 nt, Artificial Sequence
  Synthetic oligonucleotide
aacuuuuaacacuucaccuuuaacugc

SEQ ID NO: 486 - RNA, 27 nt, Artificial Sequence
  Synthetic oligonucleotide
caacuuuuaacacuucaccuuuaacug

SEQ ID NO: 487 - RNA, 27 nt, Artificial Sequence
  Synthetic oligonucleotide
ccaacuuuuaacacuucaccuuuaacu

SEQ ID NO: 488 - RNA, 27 nt, Artificial Sequence
  Synthetic oligonucleotide
uccaacuuuuaacacuucaccuuuaac

SEQ ID NO: 489 - RNA, 27 nt, Artificial Sequence
  Synthetic oligonucleotide
uuccaacuuuuaacacuucaccuuuaa

SEQ ID NO: 490 - RNA, 27 nt, Artificial Sequence
  Synthetic oligonucleotide
uuuccaacuuuuaacacuucaccuuua

SEQ ID NO: 491 - RNA, 27 nt, Artificial Sequence
  Synthetic oligonucleotide
auuuccaacuuuuaacacuucaccuuu

SEQ ID NO: 492 - RNA, 27 nt, Artificial Sequence
  Synthetic oligonucleotide
uauuuccaacuuuuaacacuucaccuu

SEQ ID NO: 493 - RNA, 27 nt, Artificial Sequence
  Synthetic oligonucleotide
uuauuuccaacuuuuaacacuucaccu

SEQ ID NO: 494 - RNA, 27 nt, Artificial Sequence
  Synthetic oligonucleotide
cuuauuuccaacuuuuaacacuucacc

SEQ ID NO: 495 - RNA, 27 nt, Artificial Sequence
  Synthetic oligonucleotide
ucuuauuuccaacuuuuaacacuucac

SEQ ID NO: 496 - RNA, 27 nt, Artificial Sequence
  Synthetic oligonucleotide
cucuuauuuccaacuuuuaacacuuca

SEQ ID NO: 497 - RNA, 27 nt, Artificial Sequence
  Synthetic oligonucleotide
gcucuuauuuccaacuuuuaacacuuc

SEQ ID NO: 498 - RNA, 27 nt, Artificial Sequence
  Synthetic oligonucleotide
cacucuauauuuagcucgcuguucaau

SEQ ID NO: 499 - RNA, 27 nt, Artificial Sequence
  Synthetic oligonucleotide
ccacucuauauuuagcucgcuguucaa

SEQ ID NO: 500 - RNA, 27 nt, Artificial Sequence
  Synthetic oligonucleotide
uccacucuauauuuagcucgcuguuca

SEQ ID NO: 501 - RNA, 27 nt, Artificial Sequence
  Synthetic oligonucleotide
uuccacucuauauuuagcucgcuguuc

SEQ ID NO: 502 - RNA, 27 nt, Artificial Sequence
  Synthetic oligonucleotide
cuuccacucuauauuuagcucgcuguu

SEQ ID NO: 503 - RNA, 27 nt, Artificial Sequence
  Synthetic oligonucleotide
gcuuccacucuauauuuagcucgcugu

SEQ ID NO: 504 - RNA, 27 nt, Artificial Sequence
  Synthetic oligonucleotide
ugcuuccacucuauauuuagcucgcug

SEQ ID NO: 505 - RNA, 27 nt, Artificial Sequence
  Synthetic oligonucleotide
uugcuuccacucuauauuuagcucgcu

SEQ ID NO: 506 - RNA, 27 nt, Artificial Sequence
  Synthetic oligonucleotide
cuugcuuccacucuauauuuagcucgc

SEQ ID NO: 507 - RNA, 27 nt, Artificial Sequence
  Synthetic oligonucleotide
gcuugcuuccacucuauauuuagcucg

SEQ ID NO: 508 - RNA, 27 nt, Artificial Sequence
  Synthetic oligonucleotide
ugcuugcuuccacucuauauuuagcuc

SEQ ID NO: 509 - RNA, 27 nt, Artificial Sequence
  Synthetic oligonucleotide
uugcuugcuuccacucuauauuuagcu

SEQ ID NO: 510 - RNA, 27 nt, Artificial Sequence
  Synthetic oligonucleotide
auugcuugcuuccacucuauauuuagc

SEQ ID NO: 511 - RNA, 27 nt, Artificial Sequence
  Synthetic oligonucleotide
aauugcuugcuuccacucuauauuuag

SEQ ID NO: 512 - RNA, 27 nt, Artificial Sequence
  Synthetic oligonucleotide
aaauugcuugcuuccacucuauauuua

SEQ ID NO: 513 - RNA, 27 nt, Artificial Sequence
  Synthetic oligonucleotide
gaaauugcuugcuuccacucuauauuu

SEQ ID NO: 514 - RNA, 27 nt, Artificial Sequence
  Synthetic oligonucleotide
agaaauugcuugcuuccacucuauauu

SEQ ID NO: 515 - RNA, 27 nt, Artificial Sequence
  Synthetic oligonucleotide
cuuuuucagccacaggaaaaacccaag

SEQ ID NO: 516 - RNA, 27 nt, Artificial Sequence
  Synthetic oligonucleotide
uuaauuugcuuucucuuuuucagccac

SEQ ID NO: 517 - RNA, 27 nt, Artificial Sequence
  Synthetic oligonucleotide
aacuaauucacugcccagaucuuuaau

SEQ ID NO: 518 - RNA, 27 nt, Artificial Sequence
  Synthetic oligonucleotide
gaacuaauucacugcccagaucuuuaa

SEQ ID NO: 519 - RNA, 27 nt, Artificial Sequence
  Synthetic oligonucleotide
cgaacuaauucacugcccagaucuuua

SEQ ID NO: 520 - RNA, 27 nt, Artificial Sequence
  Synthetic oligonucleotide
gcgaacuaauucacugcccagaucuuu

SEQ ID NO: 521 - RNA, 27 nt, Artificial Sequence
  Synthetic oligonucleotide
agcgaacuaauucacugcccagaucuu

SEQ ID NO: 522 - RNA, 27 nt, Artificial Sequence
  Synthetic oligonucleotide
uagcgaacuaauucacugcccagaucu

SEQ ID NO: 523 - RNA, 27 nt, Artificial Sequence
  Synthetic oligonucleotide
guagcgaacuaauucacugcccagauc

SEQ ID NO: 524 - RNA, 27 nt, Artificial Sequence
  Synthetic oligonucleotide
cguagcgaacuaauucacugcccagau

SEQ ID NO: 525 - RNA, 27 nt, Artificial Sequence
  Synthetic oligonucleotide
ucguagcgaacuaauucacugcccaga

SEQ ID NO: 526 - RNA, 27 nt, Artificial Sequence
  Synthetic oligonucleotide
aucguagcgaacuaauucacugcccag

SEQ ID NO: 527 - RNA, 27 nt, Artificial Sequence
  Synthetic oligonucleotide
caucguagcgaacuaauucacugccca

SEQ ID NO: 528 - RNA, 27 nt, Artificial Sequence
  Synthetic oligonucleotide
gcaucguagcgaacuaauucacugccc

SEQ ID NO: 529 - RNA, 27 nt, Artificial Sequence
  Synthetic oligonucleotide
uacaagccuauccaaaugaggagugug

SEQ ID NO: 530 - RNA, 27 nt, Artificial Sequence
  Synthetic oligonucleotide
uuacaagccuauccaaaugaggagugu

SEQ ID NO: 531 - RNA, 27 nt, Artificial Sequence
  Synthetic oligonucleotide
cuuacaagccuauccaaaugaggagug

SEQ ID NO: 532 - RNA, 27 nt, Artificial Sequence
  Synthetic oligonucleotide
acuuacaagccuauccaaaugaggagu

SEQ ID NO: 533 - RNA, 27 nt, Artificial Sequence
  Synthetic oligonucleotide
cacuuacaagccuauccaaaugaggag

SEQ ID NO: 534 - RNA, 27 nt, Artificial Sequence
  Synthetic oligonucleotide
gcacuuacaagccuauccaaaugagga

SEQ ID NO: 535 - RNA, 27 nt, Artificial Sequence
  Synthetic oligonucleotide
ggcacuuacaagccuauccaaaugagg

SEQ ID NO: 536 - RNA, 27 nt, Artificial Sequence
  Synthetic oligonucleotide
gggcacuuacaagccuauccaaaugag

SEQ ID NO: 537 - RNA, 27 nt, Artificial Sequence
  Synthetic oligonucleotide
cgggcacuuacaagccuauccaaauga

SEQ ID NO: 538 - RNA, 27 nt, Artificial Sequence
  Synthetic oligonucleotide
ucgggcacuuacaagccuauccaaaug

SEQ ID NO: 539 - RNA, 27 nt, Artificial Sequence
  Synthetic oligonucleotide
uucgggcacuuacaagccuauccaaau

SEQ ID NO: 540 - RNA, 27 nt, Artificial Sequence
  Synthetic oligonucleotide
cuucgggcacuuacaagccuauccaaa

SEQ ID NO: 541 - RNA, 27 nt, Artificial Sequence
  Synthetic oligonucleotide
acuucgggcacuuacaagccuauccaa

SEQ ID NO: 542 - RNA, 27 nt, Artificial Sequence
  Synthetic oligonucleotide
cacuucgggcacuuacaagccuaucca

SEQ ID NO: 543 - RNA, 27 nt, Artificial Sequence
  Synthetic oligonucleotide
acacuucgggcacuuacaagccuaucc

SEQ ID NO: 544 - RNA, 27 nt, Artificial Sequence
  Synthetic oligonucleotide
uacacuucgggcacuuacaagccuauc

SEQ ID NO: 545 - RNA, 27 nt, Artificial Sequence
  Synthetic oligonucleotide
uuacacuucgggcacuuacaagccuau

SEQ ID NO: 546 - RNA, 27 nt, Artificial Sequence
  Synthetic oligonucleotide
cuuacacuucgggcacuuacaagccua

SEQ ID NO: 547 - RNA, 27 nt, Artificial Sequence
  Synthetic oligonucleotide
gcuuacacuucgggcacuuacaagccu

SEQ ID NO: 548 - RNA, 27 nt, Artificial Sequence
  Synthetic oligonucleotide
ggcuuacacuucgggcacuuacaagcc

SEQ ID NO: 549 - RNA, 27 nt, Artificial Sequence
  Synthetic oligonucleotide
gggcuuacacuucgggcacuuacaagc

SEQ ID NO: 550 - RNA, 27 nt, Artificial Sequence
  Synthetic oligonucleotide
ugggcuuacacuucgggcacuuacaag

SEQ ID NO: 551 - RNA, 27 nt, Artificial Sequence
  Synthetic oligonucleotide
uugggcuuacacuucgggcacuuacaa

SEQ ID NO: 552 - RNA, 27 nt, Artificial Sequence
  Synthetic oligonucleotide
guugggcuuacacuucgggcacuuaca

SEQ ID NO: 553 - RNA, 27 nt, Artificial Sequence
  Synthetic oligonucleotide
aacugaucuucuggaaaaguagcucgg

SEQ ID NO: 554 - RNA, 27 nt, Artificial Sequence
  Synthetic oligonucleotide
gauuuagagcacugaggucaaugugga

SEQ ID NO: 555 - RNA, 27 nt, Artificial Sequence
  Synthetic oligonucleotide
ggauuuagagcacugaggucaaugugg

SEQ ID NO: 556 - RNA, 27 nt, Artificial Sequence
  Synthetic oligonucleotide
uggauuuagagcacugaggucaaugug

SEQ ID NO: 557 - RNA, 27 nt, Artificial Sequence
  Synthetic oligonucleotide
cuggauuuagagcacugaggucaaugu

SEQ ID NO: 558 - RNA, 27 nt, Artificial Sequence
  Synthetic oligonucleotide
ucuggauuuagagcacugaggucaaug

SEQ ID NO: 559 - RNA, 27 nt, Artificial Sequence
  Synthetic oligonucleotide
cucuggauuuagagcacugaggucaau

SEQ ID NO: 560 - RNA, 27 nt, Artificial Sequence
  Synthetic oligonucleotide
gcucuggauuuagagcacugaggucaa

SEQ ID NO: 561 - RNA, 27 nt, Artificial Sequence
  Synthetic oligonucleotide
agcucuggauuuagagcacugagguca

SEQ ID NO: 562 - RNA, 27 nt, Artificial Sequence
  Synthetic oligonucleotide
cagcucuggauuuagagcacugagguc

SEQ ID NO: 563 - RNA, 27 nt, Artificial Sequence
  Synthetic oligonucleotide
ccagcucuggauuuagagcacugaggu

SEQ ID NO: 564 - RNA, 27 nt, Artificial Sequence
  Synthetic oligonucleotide
accagcucuggauuuagagcacugagg

SEQ ID NO: 565 - RNA, 27 nt, Artificial Sequence
  Synthetic oligonucleotide
gaccagcucuggauuuagagcacugag

SEQ ID NO: 566 - RNA, 27 nt, Artificial Sequence
  Synthetic oligonucleotide
ggaccagcucuggauuuagagcacuga

SEQ ID NO: 567 - RNA, 27 nt, Artificial Sequence
  Synthetic oligonucleotide
uggaccagcucuggauuuagagcacug

SEQ ID NO: 568 - RNA, 27 nt, Artificial Sequence
  Synthetic oligonucleotide
cuggaccagcucuggauuuagagcacu

SEQ ID NO: 569 - RNA, 27 nt, Artificial Sequence
  Synthetic oligonucleotide
ccuggaccagcucuggauuuagagcac

SEQ ID NO: 570 - RNA, 27 nt, Artificial Sequence
  Synthetic oligonucleotide
gccuggaccagcucuggauuuagagca

SEQ ID NO: 571 - RNA, 27 nt, Artificial Sequence
  Synthetic oligonucleotide
ugccuggaccagcucuggauuuagagc

SEQ ID NO: 572 - RNA, 27 nt, Artificial Sequence
  Synthetic oligonucleotide
cugccuggaccagcucuggauuuagag

SEQ ID NO: 573 - RNA, 27 nt, Artificial Sequence
  Synthetic oligonucleotide
acugccuggaccagcucuggauuuaga

SEQ ID NO: 574 - RNA, 27 nt, Artificial Sequence
  Synthetic oligonucleotide
cuucauugaaaugcacaaucaggcuac

SEQ ID NO: 575 - RNA, 27 nt, Artificial Sequence
  Synthetic oligonucleotide
acuucauugaaaugcacaaucaggcua

SEQ ID NO: 576 - RNA, 27 nt, Artificial Sequence
  Synthetic oligonucleotide
gacuucauugaaaugcacaaucaggcu

SEQ ID NO: 577 - RNA, 27 nt, Artificial Sequence
  Synthetic oligonucleotide
ugacuucauugaaaugcacaaucaggc

SEQ ID NO: 578 - RNA, 27 nt, Artificial Sequence
  Synthetic oligonucleotide
augacuucauugaaaugcacaaucagg

SEQ ID NO: 579 - RNA, 27 nt, Artificial Sequence
  Synthetic oligonucleotide
uaugacuucauugaaaugcacaaucag

SEQ ID NO: 580 - RNA, 27 nt, Artificial Sequence
  Synthetic oligonucleotide
cuaugacuucauugaaaugcacaauca

SEQ ID NO: 581 - RNA, 27 nt, Artificial Sequence
  Synthetic oligonucleotide
ccuaugacuucauugaaaugcacaauc

SEQ ID NO: 582 - RNA, 27 nt, Artificial Sequence
  Synthetic oligonucleotide
uccuaugacuucauugaaaugcacaau

SEQ ID NO: 583 - RNA, 27 nt, Artificial Sequence
  Synthetic oligonucleotide
uuccuaugacuucauugaaaugcacaa

SEQ ID NO: 584 - RNA, 27 nt, Artificial Sequence
  Synthetic oligonucleotide
cuuccuaugacuucauugaaaugcaca

SEQ ID NO: 585 - RNA, 27 nt, Artificial Sequence
  Synthetic oligonucleotide
ucuuccuaugacuucauugaaaugcac

SEQ ID NO: 586 - RNA, 27 nt, Artificial Sequence
  Synthetic oligonucleotide
cucuuccuaugacuucauugaaaugca

SEQ ID NO: 587 - RNA, 27 nt, Artificial Sequence
  Synthetic oligonucleotide
ccucuuccuaugacuucauugaaaugc

SEQ ID NO: 588 - RNA, 27 nt, Artificial Sequence
  Synthetic oligonucleotide
cccucuuccuaugacuucauugaaaug

SEQ ID NO: 589 - RNA, 27 nt, Artificial Sequence
  Synthetic oligonucleotide
gcccucuuccuaugacuucauugaaau

SEQ ID NO: 590 - RNA, 27 nt, Artificial Sequence
  Synthetic oligonucleotide
ugcccucuuccuaugacuucauugaaa

SEQ ID NO: 591 - RNA, 27 nt, Artificial Sequence
  Synthetic oligonucleotide
augcccucuuccuaugacuucauugaa

SEQ ID NO: 592 - RNA, 27 nt, Artificial Sequence
  Synthetic oligonucleotide
aaugcccucuuccuaugacuucauuga

SEQ ID NO: 593 - RNA, 27 nt, Artificial Sequence
  Synthetic oligonucleotide
aaaugcccucuuccuaugacuucauug

SEQ ID NO: 594 - RNA, 27 nt, Artificial Sequence
  Synthetic oligonucleotide
aaaaugcccucuuccuaugacuucauu

SEQ ID NO: 595 - RNA, 27 nt, Artificial Sequence
  Synthetic oligonucleotide
caaaaugcccucuuccuaugacuucau

SEQ ID NO: 596 - RNA, 27 nt, Artificial Sequence
  Synthetic oligonucleotide
ccaaaaugcccucuuccuaugacuuca

SEQ ID NO: 597 - RNA, 27 nt, Artificial Sequence
  Synthetic oligonucleotide
accaaaaugcccucuuccuaugacuuc

SEQ ID NO: 598 - RNA, 27 nt, Artificial Sequence
  Synthetic oligonucleotide
aaccaaaaugcccucuuccuaugacuu

SEQ ID NO: 599 - RNA, 27 nt, Artificial Sequence
  Synthetic oligonucleotide
caaccaaaaugcccucuuccuaugacu

SEQ ID NO: 600 - RNA, 27 nt, Artificial Sequence
  Synthetic oligonucleotide
acaaccaaaaugcccucuuccuaugac

SEQ ID NO: 601 - RNA, 27 nt, Artificial Sequence
  Synthetic oligonucleotide
cacaaccaaaaugcccucuuccuauga

SEQ ID NO: 602 - RNA, 27 nt, Artificial Sequence
  Synthetic oligonucleotide
auuucacagcacagugaauuuucuugc

SEQ ID NO: 603 - RNA, 27 nt, Artificial Sequence
  Synthetic oligonucleotide
gauuucacagcacagugaauuuucuug

SEQ ID NO: 604 - RNA, 27 nt, Artificial Sequence
  Synthetic oligonucleotide
ggauuucacagcacagugaauuuucuu

SEQ ID NO: 605 - RNA, 27 nt, Artificial Sequence
  Synthetic oligonucleotide
aggauuucacagcacagugaauuuucu

SEQ ID NO: 606 - RNA, 27 nt, Artificial Sequence
  Synthetic oligonucleotide
aaggauuucacagcacagugaauuuuc

SEQ ID NO: 607 - RNA, 27 nt, Artificial Sequence
  Synthetic oligonucleotide
caaggauuucacagcacagugaauuuu

SEQ ID NO: 608 - RNA, 27 nt, Artificial Sequence
  Synthetic oligonucleotide
ucaaggauuucacagcacagugaauuu

SEQ ID NO: 609 - RNA, 27 nt, Artificial Sequence
  Synthetic oligonucleotide
uucaaggauuucacagcacagugaauu

SEQ ID NO: 610 - RNA, 27 nt, Artificial Sequence
  Synthetic oligonucleotide
guucaaggauuucacagcacagugaau

SEQ ID NO: 611 - RNA, 27 nt, Artificial Sequence
  Synthetic oligonucleotide
uguucaaggauuucacagcacagugaa

SEQ ID NO: 612 - RNA, 27 nt, Artificial Sequence
  Synthetic oligonucleotide
cuguucaaggauuucacagcacaguga

SEQ ID NO: 613 - RNA, 27 nt, Artificial Sequence
  Synthetic oligonucleotide
uaaaaucuuucaugaugauucccucgg

SEQ ID NO: 614 - RNA, 27 nt, Artificial Sequence
  Synthetic oligonucleotide
cuaaaaucuuucaugaugauucccucg

SEQ ID NO: 615 - RNA, 27 nt, Artificial Sequence
  Synthetic oligonucleotide
cuuuuacaguuggauuaugagucucau

SEQ ID NO: 616 - RNA, 27 nt, Artificial Sequence
  Synthetic oligonucleotide
ucuuuuacaguuggauuaugagucuca

SEQ ID NO: 617 - RNA, 27 nt, Artificial Sequence
  Synthetic oligonucleotide
ccaaagccaauaagaucuuuuacaguu

SEQ ID NO: 618 - RNA, 27 nt, Artificial Sequence
  Synthetic oligonucleotide
cuuuggcuacuugaagaccaaagccaa

SEQ ID NO: 619 - RNA, 27 nt, Artificial Sequence
  Synthetic oligonucleotide
auuucaugccuuuggcuacuugaagac

SEQ ID NO: 620 - RNA, 27 nt, Artificial Sequence
  Synthetic oligonucleotide
uauuucaugccuuuggcuacuugaaga

SEQ ID NO: 621 - RNA, 27 nt, Artificial Sequence
  Synthetic oligonucleotide
auauuucaugccuuuggcuacuugaag

SEQ ID NO: 622 - RNA, 27 nt, Artificial Sequence
  Synthetic oligonucleotide
gauauuucaugccuuuggcuacuugaa

SEQ ID NO: 623 - RNA, 27 nt, Artificial Sequence
  Synthetic oligonucleotide
agauauuucaugccuuuggcuacuuga

SEQ ID NO: 624 - RNA, 27 nt, Artificial Sequence
  Synthetic oligonucleotide
aagauauuucaugccuuuggcuacuug

SEQ ID NO: 625 - RNA, 27 nt, Artificial Sequence
  Synthetic oligonucleotide
caagauauuucaugccuuuggcuacuu

SEQ ID NO: 626 - RNA, 27 nt, Artificial Sequence
  Synthetic oligonucleotide
gcaagauauuucaugccuuuggcuacu

SEQ ID NO: 627 - RNA, 27 nt, Artificial Sequence
  Synthetic oligonucleotide
ugcaagauauuucaugccuuuggcuac

SEQ ID NO: 628 - RNA, 27 nt, Artificial Sequence
  Synthetic oligonucleotide
uugcaagauauuucaugccuuuggcua

SEQ ID NO: 629 - RNA, 27 nt, Artificial Sequence
  Synthetic oligonucleotide
cuugcaagauauuucaugccuuuggcu

SEQ ID NO: 630 - RNA, 27 nt, Artificial Sequence
  Synthetic oligonucleotide
gcuugcaagauauuucaugccuuuggc

SEQ ID NO: 631 - RNA, 27 nt, Artificial Sequence
  Synthetic oligonucleotide
ugcuugcaagauauuucaugccuuugg

SEQ ID NO: 632 - RNA, 27 nt, Artificial Sequence
  Synthetic oligonucleotide
uugcuugcaagauauuucaugccuuug

SEQ ID NO: 633 - RNA, 27 nt, Artificial Sequence
  Synthetic oligonucleotide
agucucuguggacaaacuuuuugcuug

SEQ ID NO: 634 - RNA, 27 nt, Artificial Sequence
  Synthetic oligonucleotide
aagucucuguggacaaacuuuuugcuu

SEQ ID NO: 635 - RNA, 27 nt, Artificial Sequence
  Synthetic oligonucleotide
caagucucuguggacaaacuuuuugcu

SEQ ID NO: 636 - RNA, 27 nt, Artificial Sequence
  Synthetic oligonucleotide
ccaagucucuguggacaaacuuuuugc

SEQ ID NO: 637 - RNA, 27 nt, Artificial Sequence
  Synthetic oligonucleotide
gccaagucucuguggacaaacuuuuug

SEQ ID NO: 638 - RNA, 27 nt, Artificial Sequence
  Synthetic oligonucleotide
agccaagucucuguggacaaacuuuuu

SEQ ID NO: 639 - RNA, 27 nt, Artificial Sequence
  Synthetic oligonucleotide
cagccaagucucuguggacaaacuuuu

SEQ ID NO: 640 - RNA, 27 nt, Artificial Sequence
  Synthetic oligonucleotide
gcagccaagucucuguggacaaacuuu

SEQ ID NO: 641 - RNA, 27 nt, Artificial Sequence
  Synthetic oligonucleotide
cagcauacaguuucuugcagccaaguc

SEQ ID NO: 642 - RNA, 27 nt, Artificial Sequence
  Synthetic oligonucleotide
uccagcauacaguuucuugcagccaag

SEQ ID NO: 643 - RNA, 27 nt, Artificial Sequence
  Synthetic oligonucleotide
auccagcauacaguuucuugcagccaa

SEQ ID NO: 644 - RNA, 27 nt, Artificial Sequence
  Synthetic oligonucleotide
cauccagcauacaguuucuugcagcca

SEQ ID NO: 645 - RNA, 27 nt, Artificial Sequence
  Synthetic oligonucleotide
ucauccagcauacaguuucuugcagcc

SEQ ID NO: 646 - RNA, 27 nt, Artificial Sequence
  Synthetic oligonucleotide
caagaccaaaaucagcaaccuugacug

SEQ ID NO: 647 - RNA, 27 nt, Artificial Sequence
  Synthetic oligonucleotide
ucuggcaagaccaaaaucagcaaccuu

SEQ ID NO: 648 - RNA, 27 nt, Artificial Sequence
  Synthetic oligonucleotide
ucucuggcaagaccaaaaucagcaacc

SEQ ID NO: 649 - RNA, 27 nt, Artificial Sequence
  Synthetic oligonucleotide
uaucauacaugucucuggcaagaccaa

SEQ ID NO: 650 - RNA, 27 nt, Artificial Sequence
  Synthetic oligonucleotide
uuaucauacaugucucuggcaagacca

SEQ ID NO: 651 - RNA, 27 nt, Artificial Sequence
  Synthetic oligonucleotide
caaagccauccacuucacuggcagcuu

SEQ ID NO: 652 - RNA, 27 nt, Artificial Sequence
  Synthetic oligonucleotide
ccaaagccauccacuucacuggcagcu

SEQ ID NO: 653 - RNA, 27 nt, Artificial Sequence
  Synthetic oligonucleotide
uugcagacuuuccaaagccauccacuu

SEQ ID NO: 654 - RNA, 27 nt, Artificial Sequence
  Synthetic oligonucleotide
guuugcagacuuuccaaagccauccac

SEQ ID NO: 655 - RNA, 27 nt, Artificial Sequence
  Synthetic oligonucleotide
cuuuugaguuugcagacuuuccaaagc

SEQ ID NO: 656 - RNA, 27 nt, Artificial Sequence
  Synthetic oligonucleotide
cagcucccagaggagcacgccaaagga

SEQ ID NO: 657 - RNA, 27 nt, Artificial Sequence
  Synthetic oligonucleotide
aucagcucccagaggagcacgccaaag

SEQ ID NO: 658 - RNA, 27 nt, Artificial Sequence
  Synthetic oligonucleotide
caucagcucccagaggagcacgccaaa

SEQ ID NO: 659 - RNA, 27 nt, Artificial Sequence
  Synthetic oligonucleotide
ucaucagcucccagaggagcacgccaa

SEQ ID NO: 660 - RNA, 27 nt, Artificial Sequence
  Synthetic oligonucleotide
gucaucagcucccagaggagcacgcca

SEQ ID NO: 661 - RNA, 27 nt, Artificial Sequence
  Synthetic oligonucleotide
uuacguucacauaaguagcguucacau

SEQ ID NO: 662 - RNA, 27 nt, Artificial Sequence
  Synthetic oligonucleotide
uuuacguucacauaaguagcguucaca

SEQ ID NO: 663 - RNA, 27 nt, Artificial Sequence
  Synthetic oligonucleotide
cagcguuaucuucugaugacaacagag

SEQ ID NO: 664 - RNA, 27 nt, Artificial Sequence
  Synthetic oligonucleotide
aauagugcaauuuuggcaagagcaaag

SEQ ID NO: 665 - RNA, 27 nt, Artificial Sequence
  Synthetic oligonucleotide
agaauccaguaauuuaaauaacaauac

SEQ ID NO: 666 - RNA, 27 nt, Artificial Sequence
  Synthetic oligonucleotide
agauaagaaauuccuuagaauccagua

SEQ ID NO: 667 - RNA, 27 nt, Artificial Sequence
  Synthetic oligonucleotide
cagauaagaaauuccuuagaauccagu

SEQ ID NO: 668 - RNA, 27 nt, Artificial Sequence
  Synthetic oligonucleotide
uaccugauuuuuaaaaaauucaaccca

SEQ ID NO: 669 - RNA, 27 nt, Artificial Sequence
  Synthetic oligonucleotide
aacaaacauuuaaaagggaauguuuac

SEQ ID NO: 670 - RNA, 27 nt, Artificial Sequence
  Synthetic oligonucleotide
ucucaaaaaacaaacaaacauuuaaaa

SEQ ID NO: 671 - RNA, 27 nt, Artificial Sequence
  Synthetic oligonucleotide
cagcccuggcaacagagugagauccug

SEQ ID NO: 672 - RNA, 27 nt, Artificial Sequence
  Synthetic oligonucleotide
uacagcccuggcaacagagugagaucc

SEQ ID NO: 673 - RNA, 27 nt, Artificial Sequence
  Synthetic oligonucleotide
gcacuacagcccuggcaacagagugag

SEQ ID NO: 674 - RNA, 27 nt, Artificial Sequence
  Synthetic oligonucleotide
cugcacuacagcccuggcaacagagug

SEQ ID NO: 675 - RNA, 27 nt, Artificial Sequence
  Synthetic oligonucleotide
accacugcacuacagcccuggcaacag

SEQ ID NO: 676 - RNA, 27 nt, Artificial Sequence
  Synthetic oligonucleotide
cuaugaucacaccacugcacuacagcc

SEQ ID NO: 677 - RNA, 27 nt, Artificial Sequence
  Synthetic oligonucleotide
cagugagcuaugaucacaccacugcac

SEQ ID NO: 678 - RNA, 27 nt, Artificial Sequence
  Synthetic oligonucleotide
ucuacaaaaaauacaaaaauuagccgg

SEQ ID NO: 679 - RNA, 27 nt, Artificial Sequence
  Synthetic oligonucleotide
ggaaugucuauacaaaaauuuauaagg

SEQ ID NO: 680 - RNA, 27 nt, Artificial Sequence
  Synthetic oligonucleotide
uguauugccuauaaauauucuuccaac

SEQ ID NO: 681 - RNA, 27 nt, Artificial Sequence
  Synthetic oligonucleotide
uguucauuuauaaacauguuuugugug

SEQ ID NO: 682 - RNA, 27 nt, Artificial Sequence
  Synthetic oligonucleotide
auuucauacaaauuuucuuaaugucau

SEQ ID NO: 683 - RNA, 27 nt, Artificial Sequence
  Synthetic oligonucleotide
aguuuucauuuaaaaaaauacacacaa

SEQ ID NO: 684 - RNA, 27 nt, Artificial Sequence
  Synthetic oligonucleotide
uauccugcuuuacaaacaugcugaguu

SEQ ID NO: 685 - RNA, 27 nt, Artificial Sequence
  Synthetic oligonucleotide
cagaggcuaaucuuuucaauccaucca

SEQ ID NO: 686 - RNA, 27 nt, Artificial Sequence
  Synthetic oligonucleotide
aguagcaagcacaaaauuccacagaau

SEQ ID NO: 687 - RNA, 27 nt, Artificial Sequence
  Synthetic oligonucleotide
caguagcaagcacaaaauuccacagaa

SEQ ID NO: 688 - RNA, 27 nt, Artificial Sequence
  Synthetic oligonucleotide
uacaguagcaagcacaaaauuccacag

SEQ ID NO: 689 - RNA, 27 nt, Artificial Sequence
  Synthetic oligonucleotide
cuauacaguagcaagcacaaaauucca

SEQ ID NO: 690 - RNA, 27 nt, Artificial Sequence
  Synthetic oligonucleotide
gcacuauacaguagcaagcacaaaauu

SEQ ID NO: 691 - RNA, 27 nt, Artificial Sequence
  Synthetic oligonucleotide
augcacuauacaguagcaagcacaaaa

SEQ ID NO: 692 - RNA, 27 nt, Artificial Sequence
  Synthetic oligonucleotide
caugcacuauacaguagcaagcacaaa

SEQ ID NO: 693 - RNA, 27 nt, Artificial Sequence
  Synthetic oligonucleotide
acaugcacuauacaguagcaagcacaa

SEQ ID NO: 694 - RNA, 27 nt, Artificial Sequence
  Synthetic oligonucleotide
cacaugcacuauacaguagcaagcaca

SEQ ID NO: 695 - RNA, 27 nt, Artificial Sequence
  Synthetic oligonucleotide
ccacaugcacuauacaguagcaagcac

SEQ ID NO: 696 - RNA, 27 nt, Artificial Sequence
  Synthetic oligonucleotide
caccacaugcacuauacaguagcaagc

SEQ ID NO: 697 - RNA, 27 nt, Artificial Sequence
  Synthetic oligonucleotide
uacaccacaugcacuauacaguagcaa

SEQ ID NO: 698 - RNA, 27 nt, Artificial Sequence
  Synthetic oligonucleotide
cuacaccacaugcacuauacaguagca

SEQ ID NO: 699 - RNA, 27 nt, Artificial Sequence
  Synthetic oligonucleotide
ccuacaccacaugcacuauacaguagc

SEQ ID NO: 700 - RNA, 27 nt, Artificial Sequence
  Synthetic oligonucleotide
uaaaaaauauaacacuuuaaauguuua

SEQ ID NO: 701 - RNA, 27 nt, Artificial Sequence
  Synthetic oligonucleotide
ucauaucauuaaaaauaaacauuuuua

SEQ ID NO: 702 - RNA, 27 nt, Artificial Sequence
  Synthetic oligonucleotide
cucauaucauuaaaaauaaacauuuuu

SEQ ID NO: 703 - RNA, 27 nt, Artificial Sequence
  Synthetic oligonucleotide
ucucauaucauuaaaaauaaacauuuu

SEQ ID NO: 704 - RNA, 27 nt, Artificial Sequence
  Synthetic oligonucleotide
auaccuuuucuaaaauguucacagugc

SEQ ID NO: 705 - RNA, 27 nt, Artificial Sequence
  Synthetic oligonucleotide
uuggcaaucaguacauuuccuuaucgc

SEQ ID NO: 706 - RNA, 27 nt, Artificial Sequence
  Synthetic oligonucleotide
auuggcaaucaguacauuuccuuaucg

SEQ ID NO: 707 - RNA, 27 nt, Artificial Sequence
  Synthetic oligonucleotide
uauuggcaaucaguacauuuccuuauc

SEQ ID NO: 708 - RNA, 27 nt, Artificial Sequence
  Synthetic oligonucleotide
guauuggcaaucaguacauuuccuuau

SEQ ID NO: 709 - RNA, 27 nt, Artificial Sequence
  Synthetic oligonucleotide
uguauuggcaaucaguacauuuccuua

SEQ ID NO: 710 - RNA, 27 nt, Artificial Sequence
  Synthetic oligonucleotide
guguauuggcaaucaguacauuuccuu

SEQ ID NO: 711 - RNA, 27 nt, Artificial Sequence
  Synthetic oligonucleotide
gguuaacccuuggcuucaaguccugau

SEQ ID NO: 712 - RNA, 27 nt, Artificial Sequence
  Synthetic oligonucleotide
ggguuaacccuuggcuucaaguccuga

SEQ ID NO: 713 - RNA, 27 nt, Artificial Sequence
  Synthetic oligonucleotide
uggguuaacccuuggcuucaaguccug

SEQ ID NO: 714 - RNA, 27 nt, Artificial Sequence
  Synthetic oligonucleotide
cuggguuaacccuuggcuucaaguccu

SEQ ID NO: 715 - RNA, 27 nt, Artificial Sequence
  Synthetic oligonucleotide
gcuggguuaacccuuggcuucaagucc

SEQ ID NO: 716 - RNA, 27 nt, Artificial Sequence
  Synthetic oligonucleotide
auuacuuauuacauuuaugaaacggca

SEQ ID NO: 717 - RNA, 27 nt, Artificial Sequence
  Synthetic oligonucleotide
ucuaaggacaaguuuauaaauagcaaa

SEQ ID NO: 718 - RNA, 27 nt, Artificial Sequence
  Synthetic oligonucleotide
cagcugcagguauaggcagugacaagu

SEQ ID NO: 719 - RNA, 27 nt, Artificial Sequence
  Synthetic oligonucleotide
ucagcugcagguauaggcagugacaag

SEQ ID NO: 720 - RNA, 27 nt, Artificial Sequence
  Synthetic oligonucleotide
uucagcugcagguauaggcagugacaa

SEQ ID NO: 721 - DNA, 27 bp, Artificial Sequence
  Synthetic oligonucleotide
ggcgcggagcgcgcgtgtggtccttgc

SEQ ID NO: 722 - DNA, 27 bp, Artificial Sequence
  Synthetic oligonucleotide
gcgcggagcgcgcgtgtggtccttgcg

SEQ ID NO: 723 - DNA, 27 bp, Artificial Sequence
  Synthetic oligonucleotide
cgcggagcgcgcgtgtggtccttgcgc

SEQ ID NO: 724 - DNA, 27 bp, Artificial Sequence
  Synthetic oligonucleotide
cggagcgcgcgtgtggtccttgcgccg

SEQ ID NO: 725 - DNA, 27 bp, Artificial Sequence
  Synthetic oligonucleotide
gagcgcgcgtgtggtccttgcgccgct

SEQ ID NO: 726 - DNA, 27 bp, Artificial Sequence
  Synthetic oligonucleotide
agcgcgcgtgtggtccttgcgccgctg

SEQ ID NO: 727 - DNA, 27 bp, Artificial Sequence
  Synthetic oligonucleotide
cgcgcgtgtggtccttgcgccgctgac

SEQ ID NO: 728 - DNA, 27 bp, Artificial Sequence
  Synthetic oligonucleotide
gcgcgtgtggtccttgcgccgctgact

SEQ ID NO: 729 - DNA, 27 bp, Artificial Sequence
  Synthetic oligonucleotide
gcgtgtggtccttgcgccgctgacttc

SEQ ID NO: 730 - DNA, 27 bp, Artificial Sequence
  Synthetic oligonucleotide
gtccttgcgccgctgacttctccactg

SEQ ID NO: 731 - DNA, 27 bp, Artificial Sequence
  Synthetic oligonucleotide
ttgcgccgctgacttctccactggttc

SEQ ID NO: 732 - DNA, 27 bp, Artificial Sequence
  Synthetic oligonucleotide
cgctgtgcttgcacctggcatcctcgt

SEQ ID NO: 733 - DNA, 27 bp, Artificial Sequence
  Synthetic oligonucleotide
ctgtgcttgcacctggcatcctcgtgc

SEQ ID NO: 734 - DNA, 27 bp, Artificial Sequence
  Synthetic oligonucleotide
tgcacctggcatcctcgtgctcctgtt

SEQ ID NO: 735 - DNA, 27 bp, Artificial Sequence
  Synthetic oligonucleotide
tcctcgtgctcctgtttaccttggtgc

SEQ ID NO: 736 - DNA, 27 bp, Artificial Sequence
  Synthetic oligonucleotide
tcgtgctcctgtttaccttggtgcaga

SEQ ID NO: 737 - DNA, 27 bp, Artificial Sequence
  Synthetic oligonucleotide
cgtgctcctgtttaccttggtgcagag

SEQ ID NO: 738 - DNA, 27 bp, Artificial Sequence
  Synthetic oligonucleotide
gccactaactacatttatgttttaaat

SEQ ID NO: 739 - DNA, 27 bp, Artificial Sequence
  Synthetic oligonucleotide
ctaactacatttatgttttaaatgagg

SEQ ID NO: 740 - DNA, 27 bp, Artificial Sequence
  Synthetic oligonucleotide
taactacatttatgttttaaatgagga

SEQ ID NO: 741 - DNA, 27 bp, Artificial Sequence
  Synthetic oligonucleotide
aactacatttatgttttaaatgaggaa

SEQ ID NO: 742 - DNA, 27 bp, Artificial Sequence
  Synthetic oligonucleotide
actacatttatgttttaaatgaggaag

SEQ ID NO: 743 - DNA, 27 bp, Artificial Sequence
  Synthetic oligonucleotide
ctacatttatgttttaaatgaggaaga

SEQ ID NO: 744 - DNA, 27 bp, Artificial Sequence
  Synthetic oligonucleotide
gctggaacacccagattgtttcccatg

SEQ ID NO: 745 - DNA, 27 bp, Artificial Sequence
  Synthetic oligonucleotide
caggactgcagcagcaaagccaattta

SEQ ID NO: 746 - DNA, 27 bp, Artificial Sequence
  Synthetic oligonucleotide
aggactgcagcagcaaagccaatttat

SEQ ID NO: 747 - DNA, 27 bp, Artificial Sequence
  Synthetic oligonucleotide
ggactgcagcagcaaagccaatttatc

SEQ ID NO: 748 - DNA, 27 bp, Artificial Sequence
  Synthetic oligonucleotide
gactgcagcagcaaagccaatttatca

SEQ ID NO: 749 - DNA, 27 bp, Artificial Sequence
  Synthetic oligonucleotide
actgcagcagcaaagccaatttatcag

SEQ ID NO: 750 - DNA, 27 bp, Artificial Sequence
  Synthetic oligonucleotide
cctactatgatgatcaactcattagct

SEQ ID NO: 751 - DNA, 27 bp, Artificial Sequence
  Synthetic oligonucleotide
ctactatgatgatcaactcattagctg

SEQ ID NO: 752 - DNA, 27 bp, Artificial Sequence
  Synthetic oligonucleotide
tactatgatgatcaactcattagctgt

SEQ ID NO: 753 - DNA, 27 bp, Artificial Sequence
  Synthetic oligonucleotide
actatgatgatcaactcattagctgtg

SEQ ID NO: 754 - DNA, 27 bp, Artificial Sequence
  Synthetic oligonucleotide
ctatgatgatcaactcattagctgtgg

SEQ ID NO: 755 - DNA, 27 bp, Artificial Sequence
  Synthetic oligonucleotide
tatgatgatcaactcattagctgtggc

SEQ ID NO: 756 - DNA, 27 bp, Artificial Sequence
  Synthetic oligonucleotide
atgatgatcaactcattagctgtggca

SEQ ID NO: 757 - DNA, 27 bp, Artificial Sequence
  Synthetic oligonucleotide
tgatgatcaactcattagctgtggcag

SEQ ID NO: 758 - DNA, 27 bp, Artificial Sequence
  Synthetic oligonucleotide
gatgatcaactcattagctgtggcagc

SEQ ID NO: 759 - DNA, 27 bp, Artificial Sequence
  Synthetic oligonucleotide
atgatcaactcattagctgtggcagcg

SEQ ID NO: 760 - DNA, 27 bp, Artificial Sequence
  Synthetic oligonucleotide
tgatcaactcattagctgtggcagcgt

SEQ ID NO: 761 - DNA, 27 bp, Artificial Sequence
  Synthetic oligonucleotide
gatcaactcattagctgtggcagcgtc

SEQ ID NO: 762 - DNA, 27 bp, Artificial Sequence
  Synthetic oligonucleotide
atcaactcattagctgtggcagcgtca

SEQ ID NO: 763 - DNA, 27 bp, Artificial Sequence
  Synthetic oligonucleotide
tcaactcattagctgtggcagcgtcaa

SEQ ID NO: 764 - DNA, 27 bp, Artificial Sequence
  Synthetic oligonucleotide
aagatggttttatgtttttgacggacc

SEQ ID NO: 765 - DNA, 27 bp, Artificial Sequence
  Synthetic oligonucleotide
gcctttgaaagcaacaattttatttac

SEQ ID NO: 766 - DNA, 27 bp, Artificial Sequence
  Synthetic oligonucleotide
agggaaactctagatgctcagactttt

SEQ ID NO: 767 - DNA, 27 bp, Artificial Sequence
  Synthetic oligonucleotide
gggaaactctagatgctcagacttttc

SEQ ID NO: 768 - DNA, 27 bp, Artificial Sequence
  Synthetic oligonucleotide
ggaaactctagatgctcagacttttca

SEQ ID NO: 769 - DNA, 27 bp, Artificial Sequence
  Synthetic oligonucleotide
gaaactctagatgctcagacttttcac

SEQ ID NO: 770 - DNA, 27 bp, Artificial Sequence
  Synthetic oligonucleotide
aaactctagatgctcagacttttcaca

SEQ ID NO: 771 - DNA, 27 bp, Artificial Sequence
  Synthetic oligonucleotide
aactctagatgctcagacttttcacac

SEQ ID NO: 772 - DNA, 27 bp, Artificial Sequence
  Synthetic oligonucleotide
cacacaagaataatcaggttctgttcc

SEQ ID NO: 773 - DNA, 27 bp, Artificial Sequence
  Synthetic oligonucleotide
cacaagaataatcaggttctgttccat

SEQ ID NO: 774 - DNA, 27 bp, Artificial Sequence
  Synthetic oligonucleotide
acaagaataatcaggttctgttccata

SEQ ID NO: 775 - DNA, 27 bp, Artificial Sequence
  Synthetic oligonucleotide
caagaataatcaggttctgttccataa

SEQ ID NO: 776 - DNA, 27 bp, Artificial Sequence
  Synthetic oligonucleotide
aagaataatcaggttctgttccataaa

SEQ ID NO: 777 - DNA, 27 bp, Artificial Sequence
  Synthetic oligonucleotide
agaataatcaggttctgttccataaac

SEQ ID NO: 778 - DNA, 27 bp, Artificial Sequence
  Synthetic oligonucleotide
ctgttccataaactctggattgcattc

SEQ ID NO: 779 - DNA, 27 bp, Artificial Sequence
  Synthetic oligonucleotide
ctggagtgtattctcacagaaaagaga

SEQ ID NO: 780 - DNA, 27 bp, Artificial Sequence
  Synthetic oligonucleotide
aaggaagtgtttaatatacttcaggct

SEQ ID NO: 781 - DNA, 27 bp, Artificial Sequence
  Synthetic oligonucleotide
ttcaggctgcgtatgtcagcaagcctg

SEQ ID NO: 782 - DNA, 27 bp, Artificial Sequence
  Synthetic oligonucleotide
tcgcacaaagcaagccagattctgccg

SEQ ID NO: 783 - DNA, 27 bp, Artificial Sequence
  Synthetic oligonucleotide
cgcacaaagcaagccagattctgccga

SEQ ID NO: 784 - DNA, 27 bp, Artificial Sequence
  Synthetic oligonucleotide
gcacaaagcaagccagattctgccgaa

SEQ ID NO: 785 - DNA, 27 bp, Artificial Sequence
  Synthetic oligonucleotide
cacaaagcaagccagattctgccgaac

SEQ ID NO: 786 - DNA, 27 bp, Artificial Sequence
  Synthetic oligonucleotide
acaaagcaagccagattctgccgaacc

SEQ ID NO: 787 - DNA, 27 bp, Artificial Sequence
  Synthetic oligonucleotide
atgtgagatgtctccagcatttttacg

SEQ ID NO: 788 - DNA, 27 bp, Artificial Sequence
  Synthetic oligonucleotide
tgtgagatgtctccagcatttttacgg

SEQ ID NO: 789 - DNA, 27 bp, Artificial Sequence
  Synthetic oligonucleotide
gtgagatgtctccagcatttttacgga

SEQ ID NO: 790 - DNA, 27 bp, Artificial Sequence
  Synthetic oligonucleotide
tgagatgtctccagcatttttacggac

SEQ ID NO: 791 - DNA, 27 bp, Artificial Sequence
  Synthetic oligonucleotide
gagatgtctccagcatttttacggacc

SEQ ID NO: 792 - DNA, 27 bp, Artificial Sequence
  Synthetic oligonucleotide
agatgtctccagcatttttacggaccc

SEQ ID NO: 793 - DNA, 27 bp, Artificial Sequence
  Synthetic oligonucleotide
gatgtctccagcatttttacggaccca

SEQ ID NO: 794 - DNA, 27 bp, Artificial Sequence
  Synthetic oligonucleotide
atgtctccagcatttttacggacccaa

SEQ ID NO: 795 - DNA, 27 bp, Artificial Sequence
  Synthetic oligonucleotide
tgtctccagcatttttacggacccaat

SEQ ID NO: 796 - DNA, 27 bp, Artificial Sequence
  Synthetic oligonucleotide
gtctccagcatttttacggacccaatc

SEQ ID NO: 797 - DNA, 27 bp, Artificial Sequence
  Synthetic oligonucleotide
tctccagcatttttacggacccaatca

SEQ ID NO: 798 - DNA, 27 bp, Artificial Sequence
  Synthetic oligonucleotide
ctccagcatttttacggacccaatcat

SEQ ID NO: 799 - DNA, 27 bp, Artificial Sequence
  Synthetic oligonucleotide
tccagcatttttacggacccaatcatg

SEQ ID NO: 800 - DNA, 27 bp, Artificial Sequence
  Synthetic oligonucleotide
ccagcatttttacggacccaatcatga

SEQ ID NO: 801 - DNA, 27 bp, Artificial Sequence
  Synthetic oligonucleotide
agtttaccacagctttgcagcgcgttg

SEQ ID NO: 802 - DNA, 27 bp, Artificial Sequence
  Synthetic oligonucleotide
tttaccacagctttgcagcgcgttgac

SEQ ID NO: 803 - DNA, 27 bp, Artificial Sequence
  Synthetic oligonucleotide
taccacagctttgcagcgcgttgactt

SEQ ID NO: 804 - DNA, 27 bp, Artificial Sequence
  Synthetic oligonucleotide
accacagctttgcagcgcgttgactta

SEQ ID NO: 805 - DNA, 27 bp, Artificial Sequence
  Synthetic oligonucleotide
cacagctttgcagcgcgttgacttatt

SEQ ID NO: 806 - DNA, 27 bp, Artificial Sequence
  Synthetic oligonucleotide
cagctttgcagcgcgttgacttattca

SEQ ID NO: 807 - DNA, 27 bp, Artificial Sequence
  Synthetic oligonucleotide
agctttgcagcgcgttgacttattcat

SEQ ID NO: 808 - DNA, 27 bp, Artificial Sequence
  Synthetic oligonucleotide
gctttgcagcgcgttgacttattcatg

SEQ ID NO: 809 - DNA, 27 bp, Artificial Sequence
  Synthetic oligonucleotide
ctttgcagcgcgttgacttattcatgg

SEQ ID NO: 810 - DNA, 27 bp, Artificial Sequence
  Synthetic oligonucleotide
gctgaccatatgtggctgggactttgg

SEQ ID NO: 811 - DNA, 27 bp, Artificial Sequence
  Synthetic oligonucleotide
ctgaccatatgtggctgggactttgga

SEQ ID NO: 812 - DNA, 27 bp, Artificial Sequence
  Synthetic oligonucleotide
tgaccatatgtggctgggactttggat

SEQ ID NO: 813 - DNA, 27 bp, Artificial Sequence
  Synthetic oligonucleotide
gaccatatgtggctgggactttggatt

SEQ ID NO: 814 - DNA, 27 bp, Artificial Sequence
  Synthetic oligonucleotide
accatatgtggctgggactttggattt

SEQ ID NO: 815 - DNA, 27 bp, Artificial Sequence
  Synthetic oligonucleotide
ccatatgtggctgggactttggatttc

SEQ ID NO: 816 - DNA, 27 bp, Artificial Sequence
  Synthetic oligonucleotide
catatgtggctgggactttggatttcg

SEQ ID NO: 817 - DNA, 27 bp, Artificial Sequence
  Synthetic oligonucleotide
atatgtggctgggactttggatttcgg

SEQ ID NO: 818 - DNA, 27 bp, Artificial Sequence
  Synthetic oligonucleotide
tatgtggctgggactttggatttcgga

SEQ ID NO: 819 - DNA, 27 bp, Artificial Sequence
  Synthetic oligonucleotide
atgtggctgggactttggatttcggag

SEQ ID NO: 820 - DNA, 27 bp, Artificial Sequence
  Synthetic oligonucleotide
ttcggaggaataataaatttgatttaa

SEQ ID NO: 821 - DNA, 27 bp, Artificial Sequence
  Synthetic oligonucleotide
aggaataataaatttgatttaaagaaa

SEQ ID NO: 822 - DNA, 27 bp, Artificial Sequence
  Synthetic oligonucleotide
ggaataataaatttgatttaaagaaaa

SEQ ID NO: 823 - DNA, 27 bp, Artificial Sequence
  Synthetic oligonucleotide
cattgaaatgcacagttggtcctgcca

SEQ ID NO: 824 - DNA, 27 bp, Artificial Sequence
  Synthetic oligonucleotide
attgaaatgcacagttggtcctgccat

SEQ ID NO: 825 - DNA, 27 bp, Artificial Sequence
  Synthetic oligonucleotide
ttcaatatgtccataattatttcaaat

SEQ ID NO: 826 - DNA, 27 bp, Artificial Sequence
  Synthetic oligonucleotide
ggtggaaaaacatgtactttaaaaagt

SEQ ID NO: 827 - DNA, 27 bp, Artificial Sequence
  Synthetic oligonucleotide
tgtaccactccttccctgcaacagctg

SEQ ID NO: 828 - DNA, 27 bp, Artificial Sequence
  Synthetic oligonucleotide
taagccttttgaaaagccagtgatgat

SEQ ID NO: 829 - DNA, 27 bp, Artificial Sequence
  Synthetic oligonucleotide
tgatattgaccctgaagcagttaaagg

SEQ ID NO: 830 - DNA, 27 bp, Artificial Sequence
  Synthetic oligonucleotide
gatattgaccctgaagcagttaaaggt

SEQ ID NO: 831 - DNA, 27 bp, Artificial Sequence
  Synthetic oligonucleotide
atattgaccctgaagcagttaaaggtg

SEQ ID NO: 832 - DNA, 27 bp, Artificial Sequence
  Synthetic oligonucleotide
tattgaccctgaagcagttaaaggtga

SEQ ID NO: 833 - DNA, 27 bp, Artificial Sequence
  Synthetic oligonucleotide
attgaccctgaagcagttaaaggtgaa

SEQ ID NO: 834 - DNA, 27 bp, Artificial Sequence
  Synthetic oligonucleotide
ttgaccctgaagcagttaaaggtgaag

SEQ ID NO: 835 - DNA, 27 bp, Artificial Sequence
  Synthetic oligonucleotide
tgaccctgaagcagttaaaggtgaagt

SEQ ID NO: 836 - DNA, 27 bp, Artificial Sequence
  Synthetic oligonucleotide
gaccctgaagcagttaaaggtgaagtg

SEQ ID NO: 837 - DNA, 27 bp, Artificial Sequence
  Synthetic oligonucleotide
accctgaagcagttaaaggtgaagtgt

SEQ ID NO: 838 - DNA, 27 bp, Artificial Sequence
  Synthetic oligonucleotide
ccctgaagcagttaaaggtgaagtgtt

SEQ ID NO: 839 - DNA, 27 bp, Artificial Sequence
  Synthetic oligonucleotide
cctgaagcagttaaaggtgaagtgtta

SEQ ID NO: 840 - DNA, 27 bp, Artificial Sequence
  Synthetic oligonucleotide
ctgaagcagttaaaggtgaagtgttaa

SEQ ID NO: 841 - DNA, 27 bp, Artificial Sequence
  Synthetic oligonucleotide
tgaagcagttaaaggtgaagtgttaaa

SEQ ID NO: 842 - DNA, 27 bp, Artificial Sequence
  Synthetic oligonucleotide
gaagcagttaaaggtgaagtgttaaaa

SEQ ID NO: 843 - DNA, 27 bp, Artificial Sequence
  Synthetic oligonucleotide
aagcagttaaaggtgaagtgttaaaag

SEQ ID NO: 844 - DNA, 27 bp, Artificial Sequence
  Synthetic oligonucleotide
agcagttaaaggtgaagtgttaaaagt

SEQ ID NO: 845 - DNA, 27 bp, Artificial Sequence
  Synthetic oligonucleotide
gcagttaaaggtgaagtgttaaaagtt

SEQ ID NO: 846 - DNA, 27 bp, Artificial Sequence
  Synthetic oligonucleotide
cagttaaaggtgaagtgttaaaagttg

SEQ ID NO: 847 - DNA, 27 bp, Artificial Sequence
  Synthetic oligonucleotide
agttaaaggtgaagtgttaaaagttgg

SEQ ID NO: 848 - DNA, 27 bp, Artificial Sequence
  Synthetic oligonucleotide
gttaaaggtgaagtgttaaaagttgga

SEQ ID NO: 849 - DNA, 27 bp, Artificial Sequence
  Synthetic oligonucleotide
ttaaaggtgaagtgttaaaagttggaa

SEQ ID NO: 850 - DNA, 27 bp, Artificial Sequence
  Synthetic oligonucleotide
taaaggtgaagtgttaaaagttggaaa

SEQ ID NO: 851 - DNA, 27 bp, Artificial Sequence
  Synthetic oligonucleotide
aaaggtgaagtgttaaaagttggaaat

SEQ ID NO: 852 - DNA, 27 bp, Artificial Sequence
  Synthetic oligonucleotide
aaggtgaagtgttaaaagttggaaata

SEQ ID NO: 853 - DNA, 27 bp, Artificial Sequence
  Synthetic oligonucleotide
aggtgaagtgttaaaagttggaaataa

SEQ ID NO: 854 - DNA, 27 bp, Artificial Sequence
  Synthetic oligonucleotide
ggtgaagtgttaaaagttggaaataag

SEQ ID NO: 855 - DNA, 27 bp, Artificial Sequence
  Synthetic oligonucleotide
gtgaagtgttaaaagttggaaataaga

SEQ ID NO: 856 - DNA, 27 bp, Artificial Sequence
  Synthetic oligonucleotide
tgaagtgttaaaagttggaaataagag

SEQ ID NO: 857 - DNA, 27 bp, Artificial Sequence
  Synthetic oligonucleotide
gaagtgttaaaagttggaaataagagc

SEQ ID NO: 858 - DNA, 27 bp, Artificial Sequence
  Synthetic oligonucleotide
attgaacagcgagctaaatatagagtg

SEQ ID NO: 859 - DNA, 27 bp, Artificial Sequence
  Synthetic oligonucleotide
ttgaacagcgagctaaatatagagtgg

SEQ ID NO: 860 - DNA, 27 bp, Artificial Sequence
  Synthetic oligonucleotide
tgaacagcgagctaaatatagagtgga

SEQ ID NO: 861 - DNA, 27 bp, Artificial Sequence
  Synthetic oligonucleotide
gaacagcgagctaaatatagagtggaa

SEQ ID NO: 862 - DNA, 27 bp, Artificial Sequence
  Synthetic oligonucleotide
aacagcgagctaaatatagagtggaag

SEQ ID NO: 863 - DNA, 27 bp, Artificial Sequence
  Synthetic oligonucleotide
acagcgagctaaatatagagtggaagc

SEQ ID NO: 864 - DNA, 27 bp, Artificial Sequence
  Synthetic oligonucleotide
cagcgagctaaatatagagtggaagca

SEQ ID NO: 865 - DNA, 27 bp, Artificial Sequence
  Synthetic oligonucleotide
agcgagctaaatatagagtggaagcaa

SEQ ID NO: 866 - DNA, 27 bp, Artificial Sequence
  Synthetic oligonucleotide
gcgagctaaatatagagtggaagcaag

SEQ ID NO: 867 - DNA, 27 bp, Artificial Sequence
  Synthetic oligonucleotide
cgagctaaatatagagtggaagcaagc

SEQ ID NO: 868 - DNA, 27 bp, Artificial Sequence
  Synthetic oligonucleotide
gagctaaatatagagtggaagcaagca

SEQ ID NO: 869 - DNA, 27 bp, Artificial Sequence
  Synthetic oligonucleotide
agctaaatatagagtggaagcaagcaa

SEQ ID NO: 870 - DNA, 27 bp, Artificial Sequence
  Synthetic oligonucleotide
gctaaatatagagtggaagcaagcaat

SEQ ID NO: 871 - DNA, 27 bp, Artificial Sequence
  Synthetic oligonucleotide
ctaaatatagagtggaagcaagcaatt

SEQ ID NO: 872 - DNA, 27 bp, Artificial Sequence
  Synthetic oligonucleotide
taaatatagagtggaagcaagcaattt

SEQ ID NO: 873 - DNA, 27 bp, Artificial Sequence
  Synthetic oligonucleotide
aaatatagagtggaagcaagcaatttc

SEQ ID NO: 874 - DNA, 27 bp, Artificial Sequence
  Synthetic oligonucleotide
aatatagagtggaagcaagcaatttct

SEQ ID NO: 875 - DNA, 27 bp, Artificial Sequence
  Synthetic oligonucleotide
cttgggtttttcctgtggctgaaaaag

SEQ ID NO: 876 - DNA, 27 bp, Artificial Sequence
  Synthetic oligonucleotide
gtggctgaaaaagagaaagcaaattaa

SEQ ID NO: 877 - DNA, 27 bp, Artificial Sequence
  Synthetic oligonucleotide
attaaagatctgggcagtgaattagtt

SEQ ID NO: 878 - DNA, 27 bp, Artificial Sequence
  Synthetic oligonucleotide
ttaaagatctgggcagtgaattagttc

SEQ ID NO: 879 - DNA, 27 bp, Artificial Sequence
  Synthetic oligonucleotide
taaagatctgggcagtgaattagttcg

SEQ ID NO: 880 - DNA, 27 bp, Artificial Sequence
  Synthetic oligonucleotide
aaagatctgggcagtgaattagttcgc

SEQ ID NO: 881 - DNA, 27 bp, Artificial Sequence
  Synthetic oligonucleotide
aagatctgggcagtgaattagttcgct

SEQ ID NO: 882 - DNA, 27 bp, Artificial Sequence
  Synthetic oligonucleotide
agatctgggcagtgaattagttcgcta

SEQ ID NO: 883 - DNA, 27 bp, Artificial Sequence
  Synthetic oligonucleotide
gatctgggcagtgaattagttcgctac

SEQ ID NO: 884 - DNA, 27 bp, Artificial Sequence
  Synthetic oligonucleotide
atctgggcagtgaattagttcgctacg

SEQ ID NO: 885 - DNA, 27 bp, Artificial Sequence
  Synthetic oligonucleotide
tctgggcagtgaattagttcgctacga

SEQ ID NO: 886 - DNA, 27 bp, Artificial Sequence
  Synthetic oligonucleotide
ctgggcagtgaattagttcgctacgat

SEQ ID NO: 887 - DNA, 27 bp, Artificial Sequence
  Synthetic oligonucleotide
tgggcagtgaattagttcgctacgatg

SEQ ID NO: 888 - DNA, 27 bp, Artificial Sequence
  Synthetic oligonucleotide
gggcagtgaattagttcgctacgatgc

SEQ ID NO: 889 - DNA, 27 bp, Artificial Sequence
  Synthetic oligonucleotide
cacactcctcatttggataggcttgta

SEQ ID NO: 890 - DNA, 27 bp, Artificial Sequence
  Synthetic oligonucleotide
acactcctcatttggataggcttgtaa

SEQ ID NO: 891 - DNA, 27 bp, Artificial Sequence
  Synthetic oligonucleotide
cactcctcatttggataggcttgtaag

SEQ ID NO: 892 - DNA, 27 bp, Artificial Sequence
  Synthetic oligonucleotide
actcctcatttggataggcttgtaagt

SEQ ID NO: 893 - DNA, 27 bp, Artificial Sequence
  Synthetic oligonucleotide
ctcctcatttggataggcttgtaagtg

SEQ ID NO: 894 - DNA, 27 bp, Artificial Sequence
  Synthetic oligonucleotide
tcctcatttggataggcttgtaagtgc

SEQ ID NO: 895 - DNA, 27 bp, Artificial Sequence
  Synthetic oligonucleotide
cctcatttggataggcttgtaagtgcc

SEQ ID NO: 896 - DNA, 27 bp, Artificial Sequence
  Synthetic oligonucleotide
ctcatttggataggcttgtaagtgccc

SEQ ID NO: 897 - DNA, 27 bp, Artificial Sequence
  Synthetic oligonucleotide
tcatttggataggcttgtaagtgcccg

SEQ ID NO: 898 - DNA, 27 bp, Artificial Sequence
  Synthetic oligonucleotide
catttggataggcttgtaagtgcccga

SEQ ID NO: 899 - DNA, 27 bp, Artificial Sequence
  Synthetic oligonucleotide
atttggataggcttgtaagtgcccgaa

SEQ ID NO: 900 - DNA, 27 bp, Artificial Sequence
  Synthetic oligonucleotide
tttggataggcttgtaagtgcccgaag

SEQ ID NO: 901 - DNA, 27 bp, Artificial Sequence
  Synthetic oligonucleotide
ttggataggcttgtaagtgcccgaagt

SEQ ID NO: 902 - DNA, 27 bp, Artificial Sequence
  Synthetic oligonucleotide
tggataggcttgtaagtgcccgaagtg

SEQ ID NO: 903 - DNA, 27 bp, Artificial Sequence
  Synthetic oligonucleotide
ggataggcttgtaagtgcccgaagtgt

SEQ ID NO: 904 - DNA, 27 bp, Artificial Sequence
  Synthetic oligonucleotide
gataggcttgtaagtgcccgaagtgta

SEQ ID NO: 905 - DNA, 27 bp, Artificial Sequence
  Synthetic oligonucleotide
ataggcttgtaagtgcccgaagtgtaa

SEQ ID NO: 906 - DNA, 27 bp, Artificial Sequence
  Synthetic oligonucleotide
taggcttgtaagtgcccgaagtgtaag

SEQ ID NO: 907 - DNA, 27 bp, Artificial Sequence
  Synthetic oligonucleotide
aggcttgtaagtgcccgaagtgtaagc

SEQ ID NO: 908 - DNA, 27 bp, Artificial Sequence
  Synthetic oligonucleotide
ggcttgtaagtgcccgaagtgtaagcc

SEQ ID NO: 909 - DNA, 27 bp, Artificial Sequence
  Synthetic oligonucleotide
gcttgtaagtgcccgaagtgtaagccc

SEQ ID NO: 910 - DNA, 27 bp, Artificial Sequence
  Synthetic oligonucleotide
cttgtaagtgcccgaagtgtaagccca

SEQ ID NO: 911 - DNA, 27 bp, Artificial Sequence
  Synthetic oligonucleotide
ttgtaagtgcccgaagtgtaagcccaa

SEQ ID NO: 912 - DNA, 27 bp, Artificial Sequence
  Synthetic oligonucleotide
tgtaagtgcccgaagtgtaagcccaac

SEQ ID NO: 913 - DNA, 27 bp, Artificial Sequence
  Synthetic oligonucleotide
ccgagctacttttccagaagatcagtt

SEQ ID NO: 914 - DNA, 27 bp, Artificial Sequence
  Synthetic oligonucleotide
tccacattgacctcagtgctctaaatc

SEQ ID NO: 915 - DNA, 27 bp, Artificial Sequence
  Synthetic oligonucleotide
ccacattgacctcagtgctctaaatcc

SEQ ID NO: 916 - DNA, 27 bp, Artificial Sequence
  Synthetic oligonucleotide
cacattgacctcagtgctctaaatcca

SEQ ID NO: 917 - DNA, 27 bp, Artificial Sequence
  Synthetic oligonucleotide
acattgacctcagtgctctaaatccag

SEQ ID NO: 918 - DNA, 27 bp, Artificial Sequence
  Synthetic oligonucleotide
cattgacctcagtgctctaaatccaga

SEQ ID NO: 919 - DNA, 27 bp, Artificial Sequence
  Synthetic oligonucleotide
attgacctcagtgctctaaatccagag

SEQ ID NO: 920 - DNA, 27 bp, Artificial Sequence
  Synthetic oligonucleotide
ttgacctcagtgctctaaatccagagc

SEQ ID NO: 921 - DNA, 27 bp, Artificial Sequence
  Synthetic oligonucleotide
tgacctcagtgctctaaatccagagct

SEQ ID NO: 922 - DNA, 27 bp, Artificial Sequence
  Synthetic oligonucleotide
gacctcagtgctctaaatccagagctg

SEQ ID NO: 923 - DNA, 27 bp, Artificial Sequence
  Synthetic oligonucleotide
acctcagtgctctaaatccagagctgg

SEQ ID NO: 924 - DNA, 27 bp, Artificial Sequence
  Synthetic oligonucleotide
cctcagtgctctaaatccagagctggt

SEQ ID NO: 925 - DNA, 27 bp, Artificial Sequence
  Synthetic oligonucleotide
ctcagtgctctaaatccagagctggtc

SEQ ID NO: 926 - DNA, 27 bp, Artificial Sequence
  Synthetic oligonucleotide
tcagtgctctaaatccagagctggtcc

SEQ ID NO: 927 - DNA, 27 bp, Artificial Sequence
  Synthetic oligonucleotide
cagtgctctaaatccagagctggtcca

SEQ ID NO: 928 - DNA, 27 bp, Artificial Sequence
  Synthetic oligonucleotide
agtgctctaaatccagagctggtccag

SEQ ID NO: 929 - DNA, 27 bp, Artificial Sequence
  Synthetic oligonucleotide
gtgctctaaatccagagctggtccagg

SEQ ID NO: 930 - DNA, 27 bp, Artificial Sequence
  Synthetic oligonucleotide
tgctctaaatccagagctggtccaggc

SEQ ID NO: 931 - DNA, 27 bp, Artificial Sequence
  Synthetic oligonucleotide
gctctaaatccagagctggtccaggca

SEQ ID NO: 932 - DNA, 27 bp, Artificial Sequence
  Synthetic oligonucleotide
ctctaaatccagagctggtccaggcag

SEQ ID NO: 933 - DNA, 27 bp, Artificial Sequence
  Synthetic oligonucleotide
tctaaatccagagctggtccaggcagt

SEQ ID NO: 934 - DNA, 27 bp, Artificial Sequence
  Synthetic oligonucleotide
gtagcctgattgtgcatttcaatgaag

SEQ ID NO: 935 - DNA, 27 bp, Artificial Sequence
  Synthetic oligonucleotide
tagcctgattgtgcatttcaatgaagt

SEQ ID NO: 936 - DNA, 27 bp, Artificial Sequence
  Synthetic oligonucleotide
agcctgattgtgcatttcaatgaagtc

SEQ ID NO: 937 - DNA, 27 bp, Artificial Sequence
  Synthetic oligonucleotide
gcctgattgtgcatttcaatgaagtca

SEQ ID NO: 938 - DNA, 27 bp, Artificial Sequence
  Synthetic oligonucleotide
cctgattgtgcatttcaatgaagtcat

SEQ ID NO: 939 - DNA, 27 bp, Artificial Sequence
  Synthetic oligonucleotide
ctgattgtgcatttcaatgaagtcata

SEQ ID NO: 940 - DNA, 27 bp, Artificial Sequence
  Synthetic oligonucleotide
tgattgtgcatttcaatgaagtcatag

SEQ ID NO: 941 - DNA, 27 bp, Artificial Sequence
  Synthetic oligonucleotide
gattgtgcatttcaatgaagtcatagg

SEQ ID NO: 942 - DNA, 27 bp, Artificial Sequence
  Synthetic oligonucleotide
attgtgcatttcaatgaagtcatagga

SEQ ID NO: 943 - DNA, 27 bp, Artificial Sequence
  Synthetic oligonucleotide
ttgtgcatttcaatgaagtcataggaa

SEQ ID NO: 944 - DNA, 27 bp, Artificial Sequence
  Synthetic oligonucleotide
tgtgcatttcaatgaagtcataggaag

SEQ ID NO: 945 - DNA, 27 bp, Artificial Sequence
  Synthetic oligonucleotide
gtgcatttcaatgaagtcataggaaga

SEQ ID NO: 946 - DNA, 27 bp, Artificial Sequence
  Synthetic oligonucleotide
tgcatttcaatgaagtcataggaagag

SEQ ID NO: 947 - DNA, 27 bp, Artificial Sequence
  Synthetic oligonucleotide
gcatttcaatgaagtcataggaagagg

SEQ ID NO: 948 - DNA, 27 bp, Artificial Sequence
  Synthetic oligonucleotide
catttcaatgaagtcataggaagaggg

SEQ ID NO: 949 - DNA, 27 bp, Artificial Sequence
  Synthetic oligonucleotide
atttcaatgaagtcataggaagagggc

SEQ ID NO: 950 - DNA, 27 bp, Artificial Sequence
  Synthetic oligonucleotide
tttcaatgaagtcataggaagagggca

SEQ ID NO: 951 - DNA, 27 bp, Artificial Sequence
  Synthetic oligonucleotide
ttcaatgaagtcataggaagagggcat

SEQ ID NO: 952 - DNA, 27 bp, Artificial Sequence
  Synthetic oligonucleotide
tcaatgaagtcataggaagagggcatt

SEQ ID NO: 953 - DNA, 27 bp, Artificial Sequence
  Synthetic oligonucleotide
caatgaagtcataggaagagggcattt

SEQ ID NO: 954 - DNA, 27 bp, Artificial Sequence
  Synthetic oligonucleotide
aatgaagtcataggaagagggcatttt

SEQ ID NO: 955 - DNA, 27 bp, Artificial Sequence
  Synthetic oligonucleotide
atgaagtcataggaagagggcattttg

SEQ ID NO: 956 - DNA, 27 bp, Artificial Sequence
  Synthetic oligonucleotide
tgaagtcataggaagagggcattttgg

SEQ ID NO: 957 - DNA, 27 bp, Artificial Sequence
  Synthetic oligonucleotide
gaagtcataggaagagggcattttggt

SEQ ID NO: 958 - DNA, 27 bp, Artificial Sequence
  Synthetic oligonucleotide
aagtcataggaagagggcattttggtt

SEQ ID NO: 959 - DNA, 27 bp, Artificial Sequence
  Synthetic oligonucleotide
agtcataggaagagggcattttggttg

SEQ ID NO: 960 - DNA, 27 bp, Artificial Sequence
  Synthetic oligonucleotide
gtcataggaagagggcattttggttgt

SEQ ID NO: 961 - DNA, 27 bp, Artificial Sequence
  Synthetic oligonucleotide
tcataggaagagggcattttggttgtg

SEQ ID NO: 962 - DNA, 27 bp, Artificial Sequence
  Synthetic oligonucleotide
gcaagaaaattcactgtgctgtgaaat

SEQ ID NO: 963 - DNA, 27 bp, Artificial Sequence
  Synthetic oligonucleotide
caagaaaattcactgtgctgtgaaatc

SEQ ID NO: 964 - DNA, 27 bp, Artificial Sequence
  Synthetic oligonucleotide
aagaaaattcactgtgctgtgaaatcc

SEQ ID NO: 965 - DNA, 27 bp, Artificial Sequence
  Synthetic oligonucleotide
agaaaattcactgtgctgtgaaatcct

SEQ ID NO: 966 - DNA, 27 bp, Artificial Sequence
  Synthetic oligonucleotide
gaaaattcactgtgctgtgaaatcctt

SEQ ID NO: 967 - DNA, 27 bp, Artificial Sequence
  Synthetic oligonucleotide
aaaattcactgtgctgtgaaatccttg

SEQ ID NO: 968 - DNA, 27 bp, Artificial Sequence
  Synthetic oligonucleotide
aaattcactgtgctgtgaaatccttga

SEQ ID NO: 969 - DNA, 27 bp, Artificial Sequence
  Synthetic oligonucleotide
aattcactgtgctgtgaaatccttgaa

SEQ ID NO: 970 - DNA, 27 bp, Artificial Sequence
  Synthetic oligonucleotide
attcactgtgctgtgaaatccttgaac

SEQ ID NO: 971 - DNA, 27 bp, Artificial Sequence
  Synthetic oligonucleotide
ttcactgtgctgtgaaatccttgaaca

SEQ ID NO: 972 - DNA, 27 bp, Artificial Sequence
  Synthetic oligonucleotide
tcactgtgctgtgaaatccttgaacag

SEQ ID NO: 973 - DNA, 27 bp, Artificial Sequence
  Synthetic oligonucleotide
ccgagggaatcatcatgaaagatttta

SEQ ID NO: 974 - DNA, 27 bp, Artificial Sequence
  Synthetic oligonucleotide
cgagggaatcatcatgaaagattttag

SEQ ID NO: 975 - DNA, 27 bp, Artificial Sequence
  Synthetic oligonucleotide
atgagactcataatccaactgtaaaag

SEQ ID NO: 976 - DNA, 27 bp, Artificial Sequence
  Synthetic oligonucleotide
tgagactcataatccaactgtaaaaga

SEQ ID NO: 977 - DNA, 27 bp, Artificial Sequence
  Synthetic oligonucleotide
aactgtaaaagatcttattggctttgg

SEQ ID NO: 978 - DNA, 27 bp, Artificial Sequence
  Synthetic oligonucleotide
ttggctttggtcttcaagtagccaaag

SEQ ID NO: 979 - DNA, 27 bp, Artificial Sequence
  Synthetic oligonucleotide
gtcttcaagtagccaaaggcatgaaat

SEQ ID NO: 980 - DNA, 27 bp, Artificial Sequence
  Synthetic oligonucleotide
tcttcaagtagccaaaggcatgaaata

SEQ ID NO: 981 - DNA, 27 bp, Artificial Sequence
  Synthetic oligonucleotide
cttcaagtagccaaaggcatgaaatat

SEQ ID NO: 982 - DNA, 27 bp, Artificial Sequence
  Synthetic oligonucleotide
ttcaagtagccaaaggcatgaaatatc

SEQ ID NO: 983 - DNA, 27 bp, Artificial Sequence
  Synthetic oligonucleotide
tcaagtagccaaaggcatgaaatatct

SEQ ID NO: 984 - DNA, 27 bp, Artificial Sequence
  Synthetic oligonucleotide
caagtagccaaaggcatgaaatatctt

SEQ ID NO: 985 - DNA, 27 bp, Artificial Sequence
  Synthetic oligonucleotide
aagtagccaaaggcatgaaatatcttg

SEQ ID NO: 986 - DNA, 27 bp, Artificial Sequence
  Synthetic oligonucleotide
agtagccaaaggcatgaaatatcttgc

SEQ ID NO: 987 - DNA, 27 bp, Artificial Sequence
  Synthetic oligonucleotide
gtagccaaaggcatgaaatatcttgca

SEQ ID NO: 988 - DNA, 27 bp, Artificial Sequence
  Synthetic oligonucleotide
tagccaaaggcatgaaatatcttgcaa

SEQ ID NO: 989 - DNA, 27 bp, Artificial Sequence
  Synthetic oligonucleotide
agccaaaggcatgaaatatcttgcaag

SEQ ID NO: 990 - DNA, 27 bp, Artificial Sequence
  Synthetic oligonucleotide
gccaaaggcatgaaatatcttgcaagc

SEQ ID NO: 991 - DNA, 27 bp, Artificial Sequence
  Synthetic oligonucleotide
ccaaaggcatgaaatatcttgcaagca

SEQ ID NO: 992 - DNA, 27 bp, Artificial Sequence
  Synthetic oligonucleotide
caaaggcatgaaatatcttgcaagcaa

SEQ ID NO: 993 - DNA, 27 bp, Artificial Sequence
  Synthetic oligonucleotide
caagcaaaaagtttgtccacagagact

SEQ ID NO: 994 - DNA, 27 bp, Artificial Sequence
  Synthetic oligonucleotide
aagcaaaaagtttgtccacagagactt

SEQ ID NO: 995 - DNA, 27 bp, Artificial Sequence
  Synthetic oligonucleotide
agcaaaaagtttgtccacagagacttg

SEQ ID NO: 996 - DNA, 27 bp, Artificial Sequence
  Synthetic oligonucleotide
gcaaaaagtttgtccacagagacttgg

SEQ ID NO: 997 - DNA, 27 bp, Artificial Sequence
  Synthetic oligonucleotide
caaaaagtttgtccacagagacttggc

SEQ ID NO: 998 - DNA, 27 bp, Artificial Sequence
  Synthetic oligonucleotide
aaaaagtttgtccacagagacttggct

SEQ ID NO: 999 - DNA, 27 bp, Artificial Sequence
  Synthetic oligonucleotide
aaaagtttgtccacagagacttggctg

SEQ ID NO: 1000 - DNA, 27 bp, Artificial Sequence
  Synthetic oligonucleotide
aaagtttgtccacagagacttggctgc

SEQ ID NO: 1001 - DNA, 27 bp, Artificial Sequence
  Synthetic oligonucleotide
gacttggctgcaagaaactgtatgctg

SEQ ID NO: 1002 - DNA, 27 bp, Artificial Sequence
  Synthetic oligonucleotide
cttggctgcaagaaactgtatgctgga

SEQ ID NO: 1003 - DNA, 27 bp, Artificial Sequence
  Synthetic oligonucleotide
ttggctgcaagaaactgtatgctggat

SEQ ID NO: 1004 - DNA, 27 bp, Artificial Sequence
  Synthetic oligonucleotide
tggctgcaagaaactgtatgctggatg

SEQ ID NO: 1005 - DNA, 27 bp, Artificial Sequence
  Synthetic oligonucleotide
ggctgcaagaaactgtatgctggatga

SEQ ID NO: 1006 - DNA, 27 bp, Artificial Sequence
  Synthetic oligonucleotide
cagtcaaggttgctgattttggtcttg

SEQ ID NO: 1007 - DNA, 27 bp, Artificial Sequence
  Synthetic oligonucleotide
aaggttgctgattttggtcttgccaga

SEQ ID NO: 1008 - DNA, 27 bp, Artificial Sequence
  Synthetic oligonucleotide
ggttgctgattttggtcttgccagaga

SEQ ID NO: 1009 - DNA, 27 bp, Artificial Sequence
  Synthetic oligonucleotide
ttggtcttgccagagacatgtatgata

SEQ ID NO: 1010 - DNA, 27 bp, Artificial Sequence
  Synthetic oligonucleotide
tggtcttgccagagacatgtatgataa

SEQ ID NO: 1011 - DNA, 27 bp, Artificial Sequence
  Synthetic oligonucleotide
aagctgccagtgaagtggatggctttg

SEQ ID NO: 1012 - DNA, 27 bp, Artificial Sequence
  Synthetic oligonucleotide
agctgccagtgaagtggatggctttgg

SEQ ID NO: 1013 - DNA, 27 bp, Artificial Sequence
  Synthetic oligonucleotide
aagtggatggctttggaaagtctgcaa

SEQ ID NO: 1014 - DNA, 27 bp, Artificial Sequence
  Synthetic oligonucleotide
gtggatggctttggaaagtctgcaaac

SEQ ID NO: 1015 - DNA, 27 bp, Artificial Sequence
  Synthetic oligonucleotide
gctttggaaagtctgcaaactcaaaag

SEQ ID NO: 1016 - DNA, 27 bp, Artificial Sequence
  Synthetic oligonucleotide
tcctttggcgtgctcctctgggagctg

SEQ ID NO: 1017 - DNA, 27 bp, Artificial Sequence
  Synthetic oligonucleotide
ctttggcgtgctcctctgggagctgat

SEQ ID NO: 1018 - DNA, 27 bp, Artificial Sequence
  Synthetic oligonucleotide
tttggcgtgctcctctgggagctgatg

SEQ ID NO: 1019 - DNA, 27 bp, Artificial Sequence
  Synthetic oligonucleotide
ttggcgtgctcctctgggagctgatga

SEQ ID NO: 1020 - DNA, 27 bp, Artificial Sequence
  Synthetic oligonucleotide
tggcgtgctcctctgggagctgatgac

SEQ ID NO: 1021 - DNA, 27 bp, Artificial Sequence
  Synthetic oligonucleotide
atgtgaacgctacttatgtgaacgtaa

SEQ ID NO: 1022 - DNA, 27 bp, Artificial Sequence
  Synthetic oligonucleotide
tgtgaacgctacttatgtgaacgtaaa

SEQ ID NO: 1023 - DNA, 27 bp, Artificial Sequence
  Synthetic oligonucleotide
ctctgttgtcatcagaagataacgctg

SEQ ID NO: 1024 - DNA, 27 bp, Artificial Sequence
  Synthetic oligonucleotide
ctttgctcttgccaaaattgcactatt

SEQ ID NO: 1025 - DNA, 27 bp, Artificial Sequence
  Synthetic oligonucleotide
gtattgttatttaaattactggattct

SEQ ID NO: 1026 - DNA, 27 bp, Artificial Sequence
  Synthetic oligonucleotide
tactggattctaaggaatttcttatct

SEQ ID NO: 1027 - DNA, 27 bp, Artificial Sequence
  Synthetic oligonucleotide
actggattctaaggaatttcttatctg

SEQ ID NO: 1028 - DNA, 27 bp, Artificial Sequence
  Synthetic oligonucleotide
tgggttgaattttttaaaaatcaggta

SEQ ID NO: 1029 - DNA, 27 bp, Artificial Sequence
  Synthetic oligonucleotide
gtaaacattcccttttaaatgtttgtt

SEQ ID NO: 1030 - DNA, 27 bp, Artificial Sequence
  Synthetic oligonucleotide
ttttaaatgtttgtttgttttttgaga

SEQ ID NO: 1031 - DNA, 27 bp, Artificial Sequence
  Synthetic oligonucleotide
caggatctcactctgttgccagggctg

SEQ ID NO: 1032 - DNA, 27 bp, Artificial Sequence
  Synthetic oligonucleotide
ggatctcactctgttgccagggctgta

SEQ ID NO: 1033 - DNA, 27 bp, Artificial Sequence
  Synthetic oligonucleotide
ctcactctgttgccagggctgtagtgc

SEQ ID NO: 1034 - DNA, 27 bp, Artificial Sequence
  Synthetic oligonucleotide
cactctgttgccagggctgtagtgcag

SEQ ID NO: 1035 - DNA, 27 bp, Artificial Sequence
  Synthetic oligonucleotide
ctgttgccagggctgtagtgcagtggt

SEQ ID NO: 1036 - DNA, 27 bp, Artificial Sequence
  Synthetic oligonucleotide
ggctgtagtgcagtggtgtgatcatag

SEQ ID NO: 1037 - DNA, 27 bp, Artificial Sequence
  Synthetic oligonucleotide
gtgcagtggtgtgatcatagctcactg

SEQ ID NO: 1038 - DNA, 27 bp, Artificial Sequence
  Synthetic oligonucleotide
ccggctaatttttgtattttttgtaga

SEQ ID NO: 1039 - DNA, 27 bp, Artificial Sequence
  Synthetic oligonucleotide
ccttataaatttttgtatagacattcc

SEQ ID NO: 1040 - DNA, 27 bp, Artificial Sequence
  Synthetic oligonucleotide
gttggaagaatatttataggcaataca

SEQ ID NO: 1041 - DNA, 27 bp, Artificial Sequence
  Synthetic oligonucleotide
cacacaaaacatgtttataaatgaaca

SEQ ID NO: 1042 - DNA, 27 bp, Artificial Sequence
  Synthetic oligonucleotide
atgacattaagaaaatttgtatgaaat

SEQ ID NO: 1043 - DNA, 27 bp, Artificial Sequence
  Synthetic oligonucleotide
ttgtgtgtatttttttaaatgaaaact

SEQ ID NO: 1044 - DNA, 27 bp, Artificial Sequence
  Synthetic oligonucleotide
aactcagcatgtttgtaaagcaggata

SEQ ID NO: 1045 - DNA, 27 bp, Artificial Sequence
  Synthetic oligonucleotide
tggatggattgaaaagattagcctctg

SEQ ID NO: 1046 - DNA, 27 bp, Artificial Sequence
  Synthetic oligonucleotide
attctgtggaattttgtgcttgctact

SEQ ID NO: 1047 - DNA, 27 bp, Artificial Sequence
  Synthetic oligonucleotide
ttctgtggaattttgtgcttgctactg

SEQ ID NO: 1048 - DNA, 27 bp, Artificial Sequence
  Synthetic oligonucleotide
ctgtggaattttgtgcttgctactgta

SEQ ID NO: 1049 - DNA, 27 bp, Artificial Sequence
  Synthetic oligonucleotide
tggaattttgtgcttgctactgtatag

SEQ ID NO: 1050 - DNA, 27 bp, Artificial Sequence
  Synthetic oligonucleotide
aattttgtgcttgctactgtatagtgc

SEQ ID NO: 1051 - DNA, 27 bp, Artificial Sequence
  Synthetic oligonucleotide
ttttgtgcttgctactgtatagtgcat

SEQ ID NO: 1052 - DNA, 27 bp, Artificial Sequence
  Synthetic oligonucleotide
tttgtgcttgctactgtatagtgcatg

SEQ ID NO: 1053 - DNA, 27 bp, Artificial Sequence
  Synthetic oligonucleotide
ttgtgcttgctactgtatagtgcatgt

SEQ ID NO: 1054 - DNA, 27 bp, Artificial Sequence
  Synthetic oligonucleotide
tgtgcttgctactgtatagtgcatgtg

SEQ ID NO: 1055 - DNA, 27 bp, Artificial Sequence
  Synthetic oligonucleotide
gtgcttgctactgtatagtgcatgtgg

SEQ ID NO: 1056 - DNA, 27 bp, Artificial Sequence
  Synthetic oligonucleotide
gcttgctactgtatagtgcatgtggtg

SEQ ID NO: 1057 - DNA, 27 bp, Artificial Sequence
  Synthetic oligonucleotide
ttgctactgtatagtgcatgtggtgta

SEQ ID NO: 1058 - DNA, 27 bp, Artificial Sequence
  Synthetic oligonucleotide
tgctactgtatagtgcatgtggtgtag

SEQ ID NO: 1059 - DNA, 27 bp, Artificial Sequence
  Synthetic oligonucleotide
gctactgtatagtgcatgtggtgtagg

SEQ ID NO: 1060 - DNA, 27 bp, Artificial Sequence
  Synthetic oligonucleotide
taaacatttaaagtgttatatttttta

SEQ ID NO: 1061 - DNA, 27 bp, Artificial Sequence
  Synthetic oligonucleotide
taaaaatgtttatttttaatgatatga

SEQ ID NO: 1062 - DNA, 27 bp, Artificial Sequence
  Synthetic oligonucleotide
aaaaatgtttatttttaatgatatgag

SEQ ID NO: 1063 - DNA, 27 bp, Artificial Sequence
  Synthetic oligonucleotide
aaaatgtttatttttaatgatatgaga

SEQ ID NO: 1064 - DNA, 27 bp, Artificial Sequence
  Synthetic oligonucleotide
gcactgtgaacattttagaaaaggtat

SEQ ID NO: 1065 - DNA, 27 bp, Artificial Sequence
  Synthetic oligonucleotide
gcgataaggaaatgtactgattgccaa

SEQ ID NO: 1066 - DNA, 27 bp, Artificial Sequence
  Synthetic oligonucleotide
cgataaggaaatgtactgattgccaat

SEQ ID NO: 1067 - DNA, 27 bp, Artificial Sequence
  Synthetic oligonucleotide
gataaggaaatgtactgattgccaata

SEQ ID NO: 1068 - DNA, 27 bp, Artificial Sequence
  Synthetic oligonucleotide
ataaggaaatgtactgattgccaatac

SEQ ID NO: 1069 - DNA, 27 bp, Artificial Sequence
  Synthetic oligonucleotide
taaggaaatgtactgattgccaataca

SEQ ID NO: 1070 - DNA, 27 bp, Artificial Sequence
  Synthetic oligonucleotide
aaggaaatgtactgattgccaatacac

SEQ ID NO: 1071 - DNA, 27 bp, Artificial Sequence
  Synthetic oligonucleotide
atcaggacttgaagccaagggttaacc

SEQ ID NO: 1072 - DNA, 27 bp, Artificial Sequence
  Synthetic oligonucleotide
tcaggacttgaagccaagggttaaccc

SEQ ID NO: 1073 - DNA, 27 bp, Artificial Sequence
  Synthetic oligonucleotide
caggacttgaagccaagggttaaccca

SEQ ID NO: 1074 - DNA, 27 bp, Artificial Sequence
  Synthetic oligonucleotide
aggacttgaagccaagggttaacccag

SEQ ID NO: 1075 - DNA, 27 bp, Artificial Sequence
  Synthetic oligonucleotide
ggacttgaagccaagggttaacccagc

SEQ ID NO: 1076 - DNA, 27 bp, Artificial Sequence
  Synthetic oligonucleotide
tgccgtttcataaatgtaataagtaat

SEQ ID NO: 1077 - DNA, 27 bp, Artificial Sequence
  Synthetic oligonucleotide
tttgctatttataaacttgtccttaga

SEQ ID NO: 1078 - DNA, 27 bp, Artificial Sequence
  Synthetic oligonucleotide
acttgtcactgcctatacctgcagctg

SEQ ID NO: 1079 - DNA, 27 bp, Artificial Sequence
  Synthetic oligonucleotide
cttgtcactgcctatacctgcagctga

SEQ ID NO: 1080 - DNA, 27 bp, Artificial Sequence
  Synthetic oligonucleotide
ttgtcactgcctatacctgcagctgaa

SEQ ID NO: 1081 - RNA, 25 nt, Artificial Sequence
  Synthetic oligonucleotide
cgcggagcgcgcgugugguccuugc

SEQ ID NO: 1082 - RNA, 25 nt, Artificial Sequence
  Synthetic oligonucleotide
gcggagcgcgcgugugguccuugcg

SEQ ID NO: 1083 - RNA, 25 nt, Artificial Sequence
  Synthetic oligonucleotide
cggagcgcgcgugugguccuugcgc

SEQ ID NO: 1084 - RNA, 25 nt, Artificial Sequence
  Synthetic oligonucleotide
gagcgcgcgugugguccuugcgccg

SEQ ID NO: 1085 - RNA, 25 nt, Artificial Sequence
  Synthetic oligonucleotide
gcgcgcgugugguccuugcgccgcu

SEQ ID NO: 1086 - RNA, 25 nt, Artificial Sequence
  Synthetic oligonucleotide
cgcgcgugugguccuugcgccgcug

SEQ ID NO: 1087 - RNA, 25 nt, Artificial Sequence
  Synthetic oligonucleotide
cgcgugugguccuugcgccgcugac

SEQ ID NO: 1088 - RNA, 25 nt, Artificial Sequence
  Synthetic oligonucleotide
gcgugugguccuugcgccgcugacu

SEQ ID NO: 1089 - RNA, 25 nt, Artificial Sequence
  Synthetic oligonucleotide
gugugguccuugcgccgcugacuuc

SEQ ID NO: 1090 - RNA, 25 nt, Artificial Sequence
  Synthetic oligonucleotide
ccuugcgccgcugacuucuccacug

SEQ ID NO: 1091 - RNA, 25 nt, Artificial Sequence
  Synthetic oligonucleotide
gcgccgcugacuucuccacugguuc

SEQ ID NO: 1092 - RNA, 25 nt, Artificial Sequence
  Synthetic oligonucleotide
cugugcuugcaccuggcauccucgu

SEQ ID NO: 1093 - RNA, 25 nt, Artificial Sequence
  Synthetic oligonucleotide
gugcuugcaccuggcauccucgugc

SEQ ID NO: 1094 - RNA, 25 nt, Artificial Sequence
  Synthetic oligonucleotide
caccuggcauccucgugcuccuguu

SEQ ID NO: 1095 - RNA, 25 nt, Artificial Sequence
  Synthetic oligonucleotide
cucgugcuccuguuuaccuuggugc

SEQ ID NO: 1096 - RNA, 25 nt, Artificial Sequence
  Synthetic oligonucleotide
gugcuccuguuuaccuuggugcaga

SEQ ID NO: 1097 - RNA, 25 nt, Artificial Sequence
  Synthetic oligonucleotide
ugcuccuguuuaccuuggugcagag

SEQ ID NO: 1098 - RNA, 25 nt, Artificial Sequence
  Synthetic oligonucleotide
cacuaacuacauuuauguuuuaaau

SEQ ID NO: 1099 - RNA, 25 nt, Artificial Sequence
  Synthetic oligonucleotide
aacuacauuuauguuuuaaaugagg

SEQ ID NO: 1100 - RNA, 25 nt, Artificial Sequence
  Synthetic oligonucleotide
acuacauuuauguuuuaaaugagga

SEQ ID NO: 1101 - RNA, 25 nt, Artificial Sequence
  Synthetic oligonucleotide
cuacauuuauguuuuaaaugaggaa

SEQ ID NO: 1102 - RNA, 25 nt, Artificial Sequence
  Synthetic oligonucleotide
uacauuuauguuuuaaaugaggaag

SEQ ID NO: 1103 - RNA, 25 nt, Artificial Sequence
  Synthetic oligonucleotide
acauuuauguuuuaaaugaggaaga

SEQ ID NO: 1104 - RNA, 25 nt, Artificial Sequence
  Synthetic oligonucleotide
uggaacacccagauuguuucccaug

SEQ ID NO: 1105 - RNA, 25 nt, Artificial Sequence
  Synthetic oligonucleotide
ggacugcagcagcaaagccaauuua

SEQ ID NO: 1106 - RNA, 25 nt, Artificial Sequence
  Synthetic oligonucleotide
gacugcagcagcaaagccaauuuau

SEQ ID NO: 1107 - RNA, 25 nt, Artificial Sequence
  Synthetic oligonucleotide
acugcagcagcaaagccaauuuauc

SEQ ID NO: 1108 - RNA, 25 nt, Artificial Sequence
  Synthetic oligonucleotide
cugcagcagcaaagccaauuuauca

SEQ ID NO: 1109 - RNA, 25 nt, Artificial Sequence
  Synthetic oligonucleotide
ugcagcagcaaagccaauuuaucag

SEQ ID NO: 1110 - RNA, 25 nt, Artificial Sequence
  Synthetic oligonucleotide
uacuaugaugaucaacucauuagcu

SEQ ID NO: 1111 - RNA, 25 nt, Artificial Sequence
  Synthetic oligonucleotide
acuaugaugaucaacucauuagcug

SEQ ID NO: 1112 - RNA, 25 nt, Artificial Sequence
  Synthetic oligonucleotide
cuaugaugaucaacucauuagcugu

SEQ ID NO: 1113 - RNA, 25 nt, Artificial Sequence
  Synthetic oligonucleotide
uaugaugaucaacucauuagcugug

SEQ ID NO: 1114 - RNA, 25 nt, Artificial Sequence
  Synthetic oligonucleotide
augaugaucaacucauuagcugugg

SEQ ID NO: 1115 - RNA, 25 nt, Artificial Sequence
  Synthetic oligonucleotide
ugaugaucaacucauuagcuguggc

SEQ ID NO: 1116 - RNA, 25 nt, Artificial Sequence
  Synthetic oligonucleotide
gaugaucaacucauuagcuguggca

SEQ ID NO: 1117 - RNA, 25 nt, Artificial Sequence
  Synthetic oligonucleotide
augaucaacucauuagcuguggcag

SEQ ID NO: 1118 - RNA, 25 nt, Artificial Sequence
  Synthetic oligonucleotide
ugaucaacucauuagcuguggcagc

SEQ ID NO: 1119 - RNA, 25 nt, Artificial Sequence
  Synthetic oligonucleotide
gaucaacucauuagcuguggcagcg

SEQ ID NO: 1120 - RNA, 25 nt, Artificial Sequence
  Synthetic oligonucleotide
aucaacucauuagcuguggcagcgu

SEQ ID NO: 1121 - RNA, 25 nt, Artificial Sequence
  Synthetic oligonucleotide
ucaacucauuagcuguggcagcguc

SEQ ID NO: 1122 - RNA, 25 nt, Artificial Sequence
  Synthetic oligonucleotide
caacucauuagcuguggcagcguca

SEQ ID NO: 1123 - RNA, 25 nt, Artificial Sequence
  Synthetic oligonucleotide
aacucauuagcuguggcagcgucaa

SEQ ID NO: 1124 - RNA, 25 nt, Artificial Sequence
  Synthetic oligonucleotide
gaugguuuuauguuuuugacggacc

SEQ ID NO: 1125 - RNA, 25 nt, Artificial Sequence
  Synthetic oligonucleotide
cuuugaaagcaacaauuuuauuuac

SEQ ID NO: 1126 - RNA, 25 nt, Artificial Sequence
  Synthetic oligonucleotide
ggaaacucuagaugcucagacuuuu

SEQ ID NO: 1127 - RNA, 25 nt, Artificial Sequence
  Synthetic oligonucleotide
gaaacucuagaugcucagacuuuuc

SEQ ID NO: 1128 - RNA, 25 nt, Artificial Sequence
  Synthetic oligonucleotide
aaacucuagaugcucagacuuuuca

SEQ ID NO: 1129 - RNA, 25 nt, Artificial Sequence
  Synthetic oligonucleotide
aacucuagaugcucagacuuuucac

SEQ ID NO: 1130 - RNA, 25 nt, Artificial Sequence
  Synthetic oligonucleotide
acucuagaugcucagacuuuucaca

SEQ ID NO: 1131 - RNA, 25 nt, Artificial Sequence
  Synthetic oligonucleotide
cucuagaugcucagacuuuucacac

SEQ ID NO: 1132 - RNA, 25 nt, Artificial Sequence
  Synthetic oligonucleotide
cacaagaauaaucagguucuguucc

SEQ ID NO: 1133 - RNA, 25 nt, Artificial Sequence
  Synthetic oligonucleotide
caagaauaaucagguucuguuccau

SEQ ID NO: 1134 - RNA, 25 nt, Artificial Sequence
  Synthetic oligonucleotide
aagaauaaucagguucuguuccaua

SEQ ID NO: 1135 - RNA, 25 nt, Artificial Sequence
  Synthetic oligonucleotide
agaauaaucagguucuguuccauaa

SEQ ID NO: 1136 - RNA, 25 nt, Artificial Sequence
  Synthetic oligonucleotide
gaauaaucagguucuguuccauaaa

SEQ ID NO: 1137 - RNA, 25 nt, Artificial Sequence
  Synthetic oligonucleotide
aauaaucagguucuguuccauaaac

SEQ ID NO: 1138 - RNA, 25 nt, Artificial Sequence
  Synthetic oligonucleotide
guuccauaaacucuggauugcauuc

SEQ ID NO: 1139 - RNA, 25 nt, Artificial Sequence
  Synthetic oligonucleotide
ggaguguauucucacagaaaagaga

SEQ ID NO: 1140 - RNA, 25 nt, Artificial Sequence
  Synthetic oligonucleotide
ggaaguguuuaauauacuucaggcu

SEQ ID NO: 1141 - RNA, 25 nt, Artificial Sequence
  Synthetic oligonucleotide
caggcugcguaugucagcaagccug

SEQ ID NO: 1142 - RNA, 25 nt, Artificial Sequence
  Synthetic oligonucleotide
gcacaaagcaagccagauucugccg

SEQ ID NO: 1143 - RNA, 25 nt, Artificial Sequence
  Synthetic oligonucleotide
cacaaagcaagccagauucugccga

SEQ ID NO: 1144 - RNA, 25 nt, Artificial Sequence
  Synthetic oligonucleotide
acaaagcaagccagauucugccgaa

SEQ ID NO: 1145 - RNA, 25 nt, Artificial Sequence
  Synthetic oligonucleotide
caaagcaagccagauucugccgaac

SEQ ID NO: 1146 - RNA, 25 nt, Artificial Sequence
  Synthetic oligonucleotide
aaagcaagccagauucugccgaacc

SEQ ID NO: 1147 - RNA, 25 nt, Artificial Sequence
  Synthetic oligonucleotide
gugagaugucuccagcauuuuuacg

SEQ ID NO: 1148 - RNA, 25 nt, Artificial Sequence
  Synthetic oligonucleotide
ugagaugucuccagcauuuuuacgg

SEQ ID NO: 1149 - RNA, 25 nt, Artificial Sequence
  Synthetic oligonucleotide
gagaugucuccagcauuuuuacgga

SEQ ID NO: 1150 - RNA, 25 nt, Artificial Sequence
  Synthetic oligonucleotide
agaugucuccagcauuuuuacggac

SEQ ID NO: 1151 - RNA, 25 nt, Artificial Sequence
  Synthetic oligonucleotide
gaugucuccagcauuuuuacggacc

SEQ ID NO: 1152 - RNA, 25 nt, Artificial Sequence
  Synthetic oligonucleotide
augucuccagcauuuuuacggaccc

SEQ ID NO: 1153 - RNA, 25 nt, Artificial Sequence
  Synthetic oligonucleotide
ugucuccagcauuuuuacggaccca

SEQ ID NO: 1154 - RNA, 25 nt, Artificial Sequence
  Synthetic oligonucleotide
gucuccagcauuuuuacggacccaa

SEQ ID NO: 1155 - RNA, 25 nt, Artificial Sequence
  Synthetic oligonucleotide
ucuccagcauuuuuacggacccaau

SEQ ID NO: 1156 - RNA, 25 nt, Artificial Sequence
  Synthetic oligonucleotide
cuccagcauuuuuacggacccaauc

SEQ ID NO: 1157 - RNA, 25 nt, Artificial Sequence
  Synthetic oligonucleotide
uccagcauuuuuacggacccaauca

SEQ ID NO: 1158 - RNA, 25 nt, Artificial Sequence
  Synthetic oligonucleotide
ccagcauuuuuacggacccaaucau

SEQ ID NO: 1159 - RNA, 25 nt, Artificial Sequence
  Synthetic oligonucleotide
cagcauuuuuacggacccaaucaug

SEQ ID NO: 1160 - RNA, 25 nt, Artificial Sequence
  Synthetic oligonucleotide
agcauuuuuacggacccaaucauga

SEQ ID NO: 1161 - RNA, 25 nt, Artificial Sequence
  Synthetic oligonucleotide
uuuaccacagcuuugcagcgcguug

SEQ ID NO: 1162 - RNA, 25 nt, Artificial Sequence
  Synthetic oligonucleotide
uaccacagcuuugcagcgcguugac

SEQ ID NO: 1163 - RNA, 25 nt, Artificial Sequence
  Synthetic oligonucleotide
ccacagcuuugcagcgcguugacuu

SEQ ID NO: 1164 - RNA, 25 nt, Artificial Sequence
  Synthetic oligonucleotide
cacagcuuugcagcgcguugacuua

SEQ ID NO: 1165 - RNA, 25 nt, Artificial Sequence
  Synthetic oligonucleotide
cagcuuugcagcgcguugacuuauu

SEQ ID NO: 1166 - RNA, 25 nt, Artificial Sequence
  Synthetic oligonucleotide
gcuuugcagcgcguugacuuauuca

SEQ ID NO: 1167 - RNA, 25 nt, Artificial Sequence
  Synthetic oligonucleotide
cuuugcagcgcguugacuuauucau

SEQ ID NO: 1168 - RNA, 25 nt, Artificial Sequence
  Synthetic oligonucleotide
uuugcagcgcguugacuuauucaug

SEQ ID NO: 1169 - RNA, 25 nt, Artificial Sequence
  Synthetic oligonucleotide
uugcagcgcguugacuuauucaugg

SEQ ID NO: 1170 - RNA, 25 nt, Artificial Sequence
  Synthetic oligonucleotide
ugaccauauguggcugggacuuugg

SEQ ID NO: 1171 - RNA, 25 nt, Artificial Sequence
  Synthetic oligonucleotide
gaccauauguggcugggacuuugga

SEQ ID NO: 1172 - RNA, 25 nt, Artificial Sequence
  Synthetic oligonucleotide
accauauguggcugggacuuuggau

SEQ ID NO: 1173 - RNA, 25 nt, Artificial Sequence
  Synthetic oligonucleotide
ccauauguggcugggacuuuggauu

SEQ ID NO: 1174 - RNA, 25 nt, Artificial Sequence
  Synthetic oligonucleotide
cauauguggcugggacuuuggauuu

SEQ ID NO: 1175 - RNA, 25 nt, Artificial Sequence
  Synthetic oligonucleotide
auauguggcugggacuuuggauuuc

SEQ ID NO: 1176 - RNA, 25 nt, Artificial Sequence
  Synthetic oligonucleotide
uauguggcugggacuuuggauuucg

SEQ ID NO: 1177 - RNA, 25 nt, Artificial Sequence
  Synthetic oligonucleotide
auguggcugggacuuuggauuucgg

SEQ ID NO: 1178 - RNA, 25 nt, Artificial Sequence
  Synthetic oligonucleotide
uguggcugggacuuuggauuucgga

SEQ ID NO: 1179 - RNA, 25 nt, Artificial Sequence
  Synthetic oligonucleotide
guggcugggacuuuggauuucggag

SEQ ID NO: 1180 - RNA, 25 nt, Artificial Sequence
  Synthetic oligonucleotide
cggaggaauaauaaauuugauuuaa

SEQ ID NO: 1181 - RNA, 25 nt, Artificial Sequence
  Synthetic oligonucleotide
gaauaauaaauuugauuuaaagaaa

SEQ ID NO: 1182 - RNA, 25 nt, Artificial Sequence
  Synthetic oligonucleotide
aauaauaaauuugauuuaaagaaaa

SEQ ID NO: 1183 - RNA, 25 nt, Artificial Sequence
  Synthetic oligonucleotide
uugaaaugcacaguugguccugcca

SEQ ID NO: 1184 - RNA, 25 nt, Artificial Sequence
  Synthetic oligonucleotide
ugaaaugcacaguugguccugccau

SEQ ID NO: 1185 - RNA, 25 nt, Artificial Sequence
  Synthetic oligonucleotide
caauauguccauaauuauuucaaau

SEQ ID NO: 1186 - RNA, 25 nt, Artificial Sequence
  Synthetic oligonucleotide
uggaaaaacauguacuuuaaaaagu

SEQ ID NO: 1187 - RNA, 25 nt, Artificial Sequence
  Synthetic oligonucleotide
uaccacuccuucccugcaacagcug

SEQ ID NO: 1188 - RNA, 25 nt, Artificial Sequence
  Synthetic oligonucleotide
agccuuuugaaaagccagugaugau

SEQ ID NO: 1189 - RNA, 25 nt, Artificial Sequence
  Synthetic oligonucleotide
auauugacccugaagcaguuaaagg

SEQ ID NO: 1190 - RNA, 25 nt, Artificial Sequence
  Synthetic oligonucleotide
uauugacccugaagcaguuaaaggu

SEQ ID NO: 1191 - RNA, 25 nt, Artificial Sequence
  Synthetic oligonucleotide
auugacccugaagcaguuaaaggug

SEQ ID NO: 1192 - RNA, 25 nt, Artificial Sequence
  Synthetic oligonucleotide
uugacccugaagcaguuaaagguga

SEQ ID NO: 1193 - RNA, 25 nt, Artificial Sequence
  Synthetic oligonucleotide
ugacccugaagcaguuaaaggugaa

SEQ ID NO: 1194 - RNA, 25 nt, Artificial Sequence
  Synthetic oligonucleotide
gacccugaagcaguuaaaggugaag

SEQ ID NO: 1195 - RNA, 25 nt, Artificial Sequence
  Synthetic oligonucleotide
acccugaagcaguuaaaggugaagu

SEQ ID NO: 1196 - RNA, 25 nt, Artificial Sequence
  Synthetic oligonucleotide
cccugaagcaguuaaaggugaagug

SEQ ID NO: 1197 - RNA, 25 nt, Artificial Sequence
  Synthetic oligonucleotide
ccugaagcaguuaaaggugaagugu

SEQ ID NO: 1198 - RNA, 25 nt, Artificial Sequence
  Synthetic oligonucleotide
cugaagcaguuaaaggugaaguguu

SEQ ID NO: 1199 - RNA, 25 nt, Artificial Sequence
  Synthetic oligonucleotide
ugaagcaguuaaaggugaaguguua

SEQ ID NO: 1200 - RNA, 25 nt, Artificial Sequence
  Synthetic oligonucleotide
gaagcaguuaaaggugaaguguuaa

SEQ ID NO: 1201 - RNA, 25 nt, Artificial Sequence
  Synthetic oligonucleotide
aagcaguuaaaggugaaguguuaaa

SEQ ID NO: 1202 - RNA, 25 nt, Artificial Sequence
  Synthetic oligonucleotide
agcaguuaaaggugaaguguuaaaa

SEQ ID NO: 1203 - RNA, 25 nt, Artificial Sequence
  Synthetic oligonucleotide
gcaguuaaaggugaaguguuaaaag

SEQ ID NO: 1204 - RNA, 25 nt, Artificial Sequence
  Synthetic oligonucleotide
caguuaaaggugaaguguuaaaagu

SEQ ID NO: 1205 - RNA, 25 nt, Artificial Sequence
  Synthetic oligonucleotide
aguuaaaggugaaguguuaaaaguu

SEQ ID NO: 1206 - RNA, 25 nt, Artificial Sequence
  Synthetic oligonucleotide
guuaaaggugaaguguuaaaaguug

SEQ ID NO: 1207 - RNA, 25 nt, Artificial Sequence
  Synthetic oligonucleotide
uuaaaggugaaguguuaaaaguugg

SEQ ID NO: 1208 - RNA, 25 nt, Artificial Sequence
  Synthetic oligonucleotide
uaaaggugaaguguuaaaaguugga

SEQ ID NO: 1209 - RNA, 25 nt, Artificial Sequence
  Synthetic oligonucleotide
aaaggugaaguguuaaaaguuggaa

SEQ ID NO: 1210 - RNA, 25 nt, Artificial Sequence
  Synthetic oligonucleotide
aaggugaaguguuaaaaguuggaaa

SEQ ID NO: 1211 - RNA, 25 nt, Artificial Sequence
  Synthetic oligonucleotide
aggugaaguguuaaaaguuggaaau

SEQ ID NO: 1212 - RNA, 25 nt, Artificial Sequence
  Synthetic oligonucleotide
ggugaaguguuaaaaguuggaaaua

SEQ ID NO: 1213 - RNA, 25 nt, Artificial Sequence
  Synthetic oligonucleotide
gugaaguguuaaaaguuggaaauaa

SEQ ID NO: 1214 - RNA, 25 nt, Artificial Sequence
  Synthetic oligonucleotide
ugaaguguuaaaaguuggaaauaag

SEQ ID NO: 1215 - RNA, 25 nt, Artificial Sequence
  Synthetic oligonucleotide
gaaguguuaaaaguuggaaauaaga

SEQ ID NO: 1216 - RNA, 25 nt, Artificial Sequence
  Synthetic oligonucleotide
aaguguuaaaaguuggaaauaagag

SEQ ID NO: 1217 - RNA, 25 nt, Artificial Sequence
  Synthetic oligonucleotide
aguguuaaaaguuggaaauaagagc

SEQ ID NO: 1218 - RNA, 25 nt, Artificial Sequence
  Synthetic oligonucleotide
ugaacagcgagcuaaauauagagug

SEQ ID NO: 1219 - RNA, 25 nt, Artificial Sequence
  Synthetic oligonucleotide
gaacagcgagcuaaauauagagugg

SEQ ID NO: 1220 - RNA, 25 nt, Artificial Sequence
  Synthetic oligonucleotide
aacagcgagcuaaauauagagugga

SEQ ID NO: 1221 - RNA, 25 nt, Artificial Sequence
  Synthetic oligonucleotide
acagcgagcuaaauauagaguggaa

SEQ ID NO: 1222 - RNA, 25 nt, Artificial Sequence
  Synthetic oligonucleotide
cagcgagcuaaauauagaguggaag

SEQ ID NO: 1223 - RNA, 25 nt, Artificial Sequence
  Synthetic oligonucleotide
agcgagcuaaauauagaguggaagc

SEQ ID NO: 1224 - RNA, 25 nt, Artificial Sequence
  Synthetic oligonucleotide
gcgagcuaaauauagaguggaagca

SEQ ID NO: 1225 - RNA, 25 nt, Artificial Sequence
  Synthetic oligonucleotide
cgagcuaaauauagaguggaagcaa

SEQ ID NO: 1226 - RNA, 25 nt, Artificial Sequence
  Synthetic oligonucleotide
gagcuaaauauagaguggaagcaag

SEQ ID NO: 1227 - RNA, 25 nt, Artificial Sequence
  Synthetic oligonucleotide
agcuaaauauagaguggaagcaagc

SEQ ID NO: 1228 - RNA, 25 nt, Artificial Sequence
  Synthetic oligonucleotide
gcuaaauauagaguggaagcaagca

SEQ ID NO: 1229 - RNA, 25 nt, Artificial Sequence
  Synthetic oligonucleotide
cuaaauauagaguggaagcaagcaa

SEQ ID NO: 1230 - RNA, 25 nt, Artificial Sequence
  Synthetic oligonucleotide
uaaauauagaguggaagcaagcaau

SEQ ID NO: 1231 - RNA, 25 nt, Artificial Sequence
  Synthetic oligonucleotide
aaauauagaguggaagcaagcaauu

SEQ ID NO: 1232 - RNA, 25 nt, Artificial Sequence
  Synthetic oligonucleotide
aauauagaguggaagcaagcaauuu

SEQ ID NO: 1233 - RNA, 25 nt, Artificial Sequence
  Synthetic oligonucleotide
auauagaguggaagcaagcaauuuc

SEQ ID NO: 1234 - RNA, 25 nt, Artificial Sequence
  Synthetic oligonucleotide
uauagaguggaagcaagcaauuucu

SEQ ID NO: 1235 - RNA, 25 nt, Artificial Sequence
  Synthetic oligonucleotide
uggguuuuuccuguggcugaaaaag

SEQ ID NO: 1236 - RNA, 25 nt, Artificial Sequence
  Synthetic oligonucleotide
ggcugaaaaagagaaagcaaauuaa

SEQ ID NO: 1237 - RNA, 25 nt, Artificial Sequence
  Synthetic oligonucleotide
uaaagaucugggcagugaauuaguu

SEQ ID NO: 1238 - RNA, 25 nt, Artificial Sequence
  Synthetic oligonucleotide
aaagaucugggcagugaauuaguuc

SEQ ID NO: 1239 - RNA, 25 nt, Artificial Sequence
  Synthetic oligonucleotide
aagaucugggcagugaauuaguucg

SEQ ID NO: 1240 - RNA, 25 nt, Artificial Sequence
  Synthetic oligonucleotide
agaucugggcagugaauuaguucgc

SEQ ID NO: 1241 - RNA, 25 nt, Artificial Sequence
  Synthetic oligonucleotide
gaucugggcagugaauuaguucgcu

SEQ ID NO: 1242 - RNA, 25 nt, Artificial Sequence
  Synthetic oligonucleotide
aucugggcagugaauuaguucgcua

SEQ ID NO: 1243 - RNA, 25 nt, Artificial Sequence
  Synthetic oligonucleotide
ucugggcagugaauuaguucgcuac

SEQ ID NO: 1244 - RNA, 25 nt, Artificial Sequence
  Synthetic oligonucleotide
cugggcagugaauuaguucgcuacg

SEQ ID NO: 1245 - RNA, 25 nt, Artificial Sequence
  Synthetic oligonucleotide
ugggcagugaauuaguucgcuacga

SEQ ID NO: 1246 - RNA, 25 nt, Artificial Sequence
  Synthetic oligonucleotide
gggcagugaauuaguucgcuacgau

SEQ ID NO: 1247 - RNA, 25 nt, Artificial Sequence
  Synthetic oligonucleotide
ggcagugaauuaguucgcuacgaug

SEQ ID NO: 1248 - RNA, 25 nt, Artificial Sequence
  Synthetic oligonucleotide
gcagugaauuaguucgcuacgaugc

SEQ ID NO: 1249 - RNA, 25 nt, Artificial Sequence
  Synthetic oligonucleotide
cacuccucauuuggauaggcuugua

SEQ ID NO: 1250 - RNA, 25 nt, Artificial Sequence
  Synthetic oligonucleotide
acuccucauuuggauaggcuuguaa

SEQ ID NO: 1251 - RNA, 25 nt, Artificial Sequence
  Synthetic oligonucleotide
cuccucauuuggauaggcuuguaag

SEQ ID NO: 1252 - RNA, 25 nt, Artificial Sequence
  Synthetic oligonucleotide
uccucauuuggauaggcuuguaagu

SEQ ID NO: 1253 - RNA, 25 nt, Artificial Sequence
  Synthetic oligonucleotide
ccucauuuggauaggcuuguaagug

SEQ ID NO: 1254 - RNA, 25 nt, Artificial Sequence
  Synthetic oligonucleotide
cucauuuggauaggcuuguaagugc

SEQ ID NO: 1255 - RNA, 25 nt, Artificial Sequence
  Synthetic oligonucleotide
ucauuuggauaggcuuguaagugcc

SEQ ID NO: 1256 - RNA, 25 nt, Artificial Sequence
  Synthetic oligonucleotide
cauuuggauaggcuuguaagugccc

SEQ ID NO: 1257 - RNA, 25 nt, Artificial Sequence
  Synthetic oligonucleotide
auuuggauaggcuuguaagugcccg

SEQ ID NO: 1258 - RNA, 25 nt, Artificial Sequence
  Synthetic oligonucleotide
uuuggauaggcuuguaagugcccga

SEQ ID NO: 1259 - RNA, 25 nt, Artificial Sequence
  Synthetic oligonucleotide
uuggauaggcuuguaagugcccgaa

SEQ ID NO: 1260 - RNA, 25 nt, Artificial Sequence
  Synthetic oligonucleotide
uggauaggcuuguaagugcccgaag

SEQ ID NO: 1261 - RNA, 25 nt, Artificial Sequence
  Synthetic oligonucleotide
ggauaggcuuguaagugcccgaagu

SEQ ID NO: 1262 - RNA, 25 nt, Artificial Sequence
  Synthetic oligonucleotide
gauaggcuuguaagugcccgaagug

SEQ ID NO: 1263 - RNA, 25 nt, Artificial Sequence
  Synthetic oligonucleotide
auaggcuuguaagugcccgaagugu

SEQ ID NO: 1264 - RNA, 25 nt, Artificial Sequence
  Synthetic oligonucleotide
uaggcuuguaagugcccgaagugua

SEQ ID NO: 1265 - RNA, 25 nt, Artificial Sequence
  Synthetic oligonucleotide
aggcuuguaagugcccgaaguguaa

SEQ ID NO: 1266 - RNA, 25 nt, Artificial Sequence
  Synthetic oligonucleotide
ggcuuguaagugcccgaaguguaag

SEQ ID NO: 1267 - RNA, 25 nt, Artificial Sequence
  Synthetic oligonucleotide
gcuuguaagugcccgaaguguaagc

SEQ ID NO: 1268 - RNA, 25 nt, Artificial Sequence
  Synthetic oligonucleotide
cuuguaagugcccgaaguguaagcc

SEQ ID NO: 1269 - RNA, 25 nt, Artificial Sequence
  Synthetic oligonucleotide
uuguaagugcccgaaguguaagccc

SEQ ID NO: 1270 - RNA, 25 nt, Artificial Sequence
  Synthetic oligonucleotide
uguaagugcccgaaguguaagccca

SEQ ID NO: 1271 - RNA, 25 nt, Artificial Sequence
  Synthetic oligonucleotide
guaagugcccgaaguguaagcccaa

SEQ ID NO: 1272 - RNA, 25 nt, Artificial Sequence
  Synthetic oligonucleotide
uaagugcccgaaguguaagcccaac

SEQ ID NO: 1273 - RNA, 25 nt, Artificial Sequence
  Synthetic oligonucleotide
gagcuacuuuuccagaagaucaguu

SEQ ID NO: 1274 - RNA, 25 nt, Artificial Sequence
  Synthetic oligonucleotide
cacauugaccucagugcucuaaauc

SEQ ID NO: 1275 - RNA, 25 nt, Artificial Sequence
  Synthetic oligonucleotide
acauugaccucagugcucuaaaucc

SEQ ID NO: 1276 - RNA, 25 nt, Artificial Sequence
  Synthetic oligonucleotide
cauugaccucagugcucuaaaucca

SEQ ID NO: 1277 - RNA, 25 nt, Artificial Sequence
  Synthetic oligonucleotide
auugaccucagugcucuaaauccag

SEQ ID NO: 1278 - RNA, 25 nt, Artificial Sequence
  Synthetic oligonucleotide
uugaccucagugcucuaaauccaga

SEQ ID NO: 1279 - RNA, 25 nt, Artificial Sequence
  Synthetic oligonucleotide
ugaccucagugcucuaaauccagag

SEQ ID NO: 1280 - RNA, 25 nt, Artificial Sequence
  Synthetic oligonucleotide
gaccucagugcucuaaauccagagc

SEQ ID NO: 1281 - RNA, 25 nt, Artificial Sequence
  Synthetic oligonucleotide
accucagugcucuaaauccagagcu

SEQ ID NO: 1282 - RNA, 25 nt, Artificial Sequence
  Synthetic oligonucleotide
ccucagugcucuaaauccagagcug

SEQ ID NO: 1283 - RNA, 25 nt, Artificial Sequence
  Synthetic oligonucleotide
cucagugcucuaaauccagagcugg

SEQ ID NO: 1284 - RNA, 25 nt, Artificial Sequence
  Synthetic oligonucleotide
ucagugcucuaaauccagagcuggu

SEQ ID NO: 1285 - RNA, 25 nt, Artificial Sequence
  Synthetic oligonucleotide
cagugcucuaaauccagagcugguc

SEQ ID NO: 1286 - RNA, 25 nt, Artificial Sequence
  Synthetic oligonucleotide
agugcucuaaauccagagcuggucc

SEQ ID NO: 1287 - RNA, 25 nt, Artificial Sequence
  Synthetic oligonucleotide
gugcucuaaauccagagcuggucca

SEQ ID NO: 1288 - RNA, 25 nt, Artificial Sequence
  Synthetic oligonucleotide
ugcucuaaauccagagcugguccag

SEQ ID NO: 1289 - RNA, 25 nt, Artificial Sequence
  Synthetic oligonucleotide
gcucuaaauccagagcugguccagg

SEQ ID NO: 1290 - RNA, 25 nt, Artificial Sequence
  Synthetic oligonucleotide
cucuaaauccagagcugguccaggc

SEQ ID NO: 1291 - RNA, 25 nt, Artificial Sequence
  Synthetic oligonucleotide
ucuaaauccagagcugguccaggca

SEQ ID NO: 1292 - RNA, 25 nt, Artificial Sequence
  Synthetic oligonucleotide
cuaaauccagagcugguccaggcag

SEQ ID NO: 1293 - RNA, 25 nt, Artificial Sequence
  Synthetic oligonucleotide
uaaauccagagcugguccaggcagu

SEQ ID NO: 1294 - RNA, 25 nt, Artificial Sequence
  Synthetic oligonucleotide
agccugauugugcauuucaaugaag

SEQ ID NO: 1295 - RNA, 25 nt, Artificial Sequence
  Synthetic oligonucleotide
gccugauugugcauuucaaugaagu

SEQ ID NO: 1296 - RNA, 25 nt, Artificial Sequence
  Synthetic oligonucleotide
ccugauugugcauuucaaugaaguc

SEQ ID NO: 1297 - RNA, 25 nt, Artificial Sequence
  Synthetic oligonucleotide
cugauugugcauuucaaugaaguca

SEQ ID NO: 1298 - RNA, 25 nt, Artificial Sequence
  Synthetic oligonucleotide
ugauugugcauuucaaugaagucau

SEQ ID NO: 1299 - RNA, 25 nt, Artificial Sequence
  Synthetic oligonucleotide
gauugugcauuucaaugaagucaua

SEQ ID NO: 1300 - RNA, 25 nt, Artificial Sequence
  Synthetic oligonucleotide
auugugcauuucaaugaagucauag

SEQ ID NO: 1301 - RNA, 25 nt, Artificial Sequence
  Synthetic oligonucleotide
uugugcauuucaaugaagucauagg

SEQ ID NO: 1302 - RNA, 25 nt, Artificial Sequence
  Synthetic oligonucleotide
ugugcauuucaaugaagucauagga

SEQ ID NO: 1303 - RNA, 25 nt, Artificial Sequence
  Synthetic oligonucleotide
gugcauuucaaugaagucauaggaa

SEQ ID NO: 1304 - RNA, 25 nt, Artificial Sequence
  Synthetic oligonucleotide
ugcauuucaaugaagucauaggaag

SEQ ID NO: 1305 - RNA, 25 nt, Artificial Sequence
  Synthetic oligonucleotide
gcauuucaaugaagucauaggaaga

SEQ ID NO: 1306 - RNA, 25 nt, Artificial Sequence
  Synthetic oligonucleotide
cauuucaaugaagucauaggaagag

SEQ ID NO: 1307 - RNA, 25 nt, Artificial Sequence
  Synthetic oligonucleotide
auuucaaugaagucauaggaagagg

SEQ ID NO: 1308 - RNA, 25 nt, Artificial Sequence
  Synthetic oligonucleotide
uuucaaugaagucauaggaagaggg

SEQ ID NO: 1309 - RNA, 25 nt, Artificial Sequence
  Synthetic oligonucleotide
uucaaugaagucauaggaagagggc

SEQ ID NO: 1310 - RNA, 25 nt, Artificial Sequence
  Synthetic oligonucleotide
ucaaugaagucauaggaagagggca

SEQ ID NO: 1311 - RNA, 25 nt, Artificial Sequence
  Synthetic oligonucleotide
caaugaagucauaggaagagggcau

SEQ ID NO: 1312 - RNA, 25 nt, Artificial Sequence
  Synthetic oligonucleotide
aaugaagucauaggaagagggcauu

SEQ ID NO: 1313 - RNA, 25 nt, Artificial Sequence
  Synthetic oligonucleotide
augaagucauaggaagagggcauuu

SEQ ID NO: 1314 - RNA, 25 nt, Artificial Sequence
  Synthetic oligonucleotide
ugaagucauaggaagagggcauuuu

SEQ ID NO: 1315 - RNA, 25 nt, Artificial Sequence
  Synthetic oligonucleotide
gaagucauaggaagagggcauuuug

SEQ ID NO: 1316 - RNA, 25 nt, Artificial Sequence
  Synthetic oligonucleotide
aagucauaggaagagggcauuuugg

SEQ ID NO: 1317 - RNA, 25 nt, Artificial Sequence
  Synthetic oligonucleotide
agucauaggaagagggcauuuuggu

SEQ ID NO: 1318 - RNA, 25 nt, Artificial Sequence
  Synthetic oligonucleotide
gucauaggaagagggcauuuugguu

SEQ ID NO: 1319 - RNA, 25 nt, Artificial Sequence
  Synthetic oligonucleotide
ucauaggaagagggcauuuugguug

SEQ ID NO: 1320 - RNA, 25 nt, Artificial Sequence
  Synthetic oligonucleotide
cauaggaagagggcauuuugguugu

SEQ ID NO: 1321 - RNA, 25 nt, Artificial Sequence
  Synthetic oligonucleotide
auaggaagagggcauuuugguugug

SEQ ID NO: 1322 - RNA, 25 nt, Artificial Sequence
  Synthetic oligonucleotide
aagaaaauucacugugcugugaaau

SEQ ID NO: 1323 - RNA, 25 nt, Artificial Sequence
  Synthetic oligonucleotide
agaaaauucacugugcugugaaauc

SEQ ID NO: 1324 - RNA, 25 nt, Artificial Sequence
  Synthetic oligonucleotide
gaaaauucacugugcugugaaaucc

SEQ ID NO: 1325 - RNA, 25 nt, Artificial Sequence
  Synthetic oligonucleotide
aaaauucacugugcugugaaauccu

SEQ ID NO: 1326 - RNA, 25 nt, Artificial Sequence
  Synthetic oligonucleotide
aaauucacugugcugugaaauccuu

SEQ ID NO: 1327 - RNA, 25 nt, Artificial Sequence
  Synthetic oligonucleotide
aauucacugugcugugaaauccuug

SEQ ID NO: 1328 - RNA, 25 nt, Artificial Sequence
  Synthetic oligonucleotide
auucacugugcugugaaauccuuga

SEQ ID NO: 1329 - RNA, 25 nt, Artificial Sequence
  Synthetic oligonucleotide
uucacugugcugugaaauccuugaa

SEQ ID NO: 1330 - RNA, 25 nt, Artificial Sequence
  Synthetic oligonucleotide
ucacugugcugugaaauccuugaac

SEQ ID NO: 1331 - RNA, 25 nt, Artificial Sequence
  Synthetic oligonucleotide
cacugugcugugaaauccuugaaca

SEQ ID NO: 1332 - RNA, 25 nt, Artificial Sequence
  Synthetic oligonucleotide
acugugcugugaaauccuugaacag

SEQ ID NO: 1333 - RNA, 25 nt, Artificial Sequence
  Synthetic oligonucleotide
gagggaaucaucaugaaagauuuua

SEQ ID NO: 1334 - RNA, 25 nt, Artificial Sequence
  Synthetic oligonucleotide
agggaaucaucaugaaagauuuuag

SEQ ID NO: 1335 - RNA, 25 nt, Artificial Sequence
  Synthetic oligonucleotide
gagacucauaauccaacuguaaaag

SEQ ID NO: 1336 - RNA, 25 nt, Artificial Sequence
  Synthetic oligonucleotide
agacucauaauccaacuguaaaaga

SEQ ID NO: 1337 - RNA, 25 nt, Artificial Sequence
  Synthetic oligonucleotide
cuguaaaagaucuuauuggcuuugg

SEQ ID NO: 1338 - RNA, 25 nt, Artificial Sequence
  Synthetic oligonucleotide
ggcuuuggucuucaaguagccaaag

SEQ ID NO: 1339 - RNA, 25 nt, Artificial Sequence
  Synthetic oligonucleotide
cuucaaguagccaaaggcaugaaau

SEQ ID NO: 1340 - RNA, 25 nt, Artificial Sequence
  Synthetic oligonucleotide
uucaaguagccaaaggcaugaaaua

SEQ ID NO: 1341 - RNA, 25 nt, Artificial Sequence
  Synthetic oligonucleotide
ucaaguagccaaaggcaugaaauau

SEQ ID NO: 1342 - RNA, 25 nt, Artificial Sequence
  Synthetic oligonucleotide
caaguagccaaaggcaugaaauauc

SEQ ID NO: 1343 - RNA, 25 nt, Artificial Sequence
  Synthetic oligonucleotide
aaguagccaaaggcaugaaauaucu

SEQ ID NO: 1344 - RNA, 25 nt, Artificial Sequence
  Synthetic oligonucleotide
aguagccaaaggcaugaaauaucuu

SEQ ID NO: 1345 - RNA, 25 nt, Artificial Sequence
  Synthetic oligonucleotide
guagccaaaggcaugaaauaucuug

SEQ ID NO: 1346 - RNA, 25 nt, Artificial Sequence
  Synthetic oligonucleotide
uagccaaaggcaugaaauaucuugc

SEQ ID NO: 1347 - RNA, 25 nt, Artificial Sequence
  Synthetic oligonucleotide
agccaaaggcaugaaauaucuugca

SEQ ID NO: 1348 - RNA, 25 nt, Artificial Sequence
  Synthetic oligonucleotide
gccaaaggcaugaaauaucuugcaa

SEQ ID NO: 1349 - RNA, 25 nt, Artificial Sequence
  Synthetic oligonucleotide
ccaaaggcaugaaauaucuugcaag

SEQ ID NO: 1350 - RNA, 25 nt, Artificial Sequence
  Synthetic oligonucleotide
caaaggcaugaaauaucuugcaagc

SEQ ID NO: 1351 - RNA, 25 nt, Artificial Sequence
  Synthetic oligonucleotide
aaaggcaugaaauaucuugcaagca

SEQ ID NO: 1352 - RNA, 25 nt, Artificial Sequence
  Synthetic oligonucleotide
aaggcaugaaauaucuugcaagcaa

SEQ ID NO: 1353 - RNA, 25 nt, Artificial Sequence
  Synthetic oligonucleotide
agcaaaaaguuuguccacagagacu

SEQ ID NO: 1354 - RNA, 25 nt, Artificial Sequence
  Synthetic oligonucleotide
gcaaaaaguuuguccacagagacuu

SEQ ID NO: 1355 - RNA, 25 nt, Artificial Sequence
  Synthetic oligonucleotide
caaaaaguuuguccacagagacuug

SEQ ID NO: 1356 - RNA, 25 nt, Artificial Sequence
  Synthetic oligonucleotide
aaaaaguuuguccacagagacuugg

SEQ ID NO: 1357 - RNA, 25 nt, Artificial Sequence
  Synthetic oligonucleotide
aaaaguuuguccacagagacuuggc

SEQ ID NO: 1358 - RNA, 25 nt, Artificial Sequence
  Synthetic oligonucleotide
aaaguuuguccacagagacuuggcu

SEQ ID NO: 1359 - RNA, 25 nt, Artificial Sequence
  Synthetic oligonucleotide
aaguuuguccacagagacuuggcug

SEQ ID NO: 1360 - RNA, 25 nt, Artificial Sequence
  Synthetic oligonucleotide
aguuuguccacagagacuuggcugc

SEQ ID NO: 1361 - RNA, 25 nt, Artificial Sequence
  Synthetic oligonucleotide
cuuggcugcaagaaacuguaugcug

SEQ ID NO: 1362 - RNA, 25 nt, Artificial Sequence
  Synthetic oligonucleotide
uggcugcaagaaacuguaugcugga

SEQ ID NO: 1363 - RNA, 25 nt, Artificial Sequence
  Synthetic oligonucleotide
ggcugcaagaaacuguaugcuggau

SEQ ID NO: 1364 - RNA, 25 nt, Artificial Sequence
  Synthetic oligonucleotide
gcugcaagaaacuguaugcuggaug

SEQ ID NO: 1365 - RNA, 25 nt, Artificial Sequence
  Synthetic oligonucleotide
cugcaagaaacuguaugcuggauga

SEQ ID NO: 1366 - RNA, 25 nt, Artificial Sequence
  Synthetic oligonucleotide
gucaagguugcugauuuuggucuug

SEQ ID NO: 1367 - RNA, 25 nt, Artificial Sequence
  Synthetic oligonucleotide
gguugcugauuuuggucuugccaga

SEQ ID NO: 1368 - RNA, 25 nt, Artificial Sequence
  Synthetic oligonucleotide
uugcugauuuuggucuugccagaga

SEQ ID NO: 1369 - RNA, 25 nt, Artificial Sequence
  Synthetic oligonucleotide
ggucuugccagagacauguaugaua

SEQ ID NO: 1370 - RNA, 25 nt, Artificial Sequence
  Synthetic oligonucleotide
gucuugccagagacauguaugauaa

SEQ ID NO: 1371 - RNA, 25 nt, Artificial Sequence
  Synthetic oligonucleotide
gcugccagugaaguggauggcuuug

SEQ ID NO: 1372 - RNA, 25 nt, Artificial Sequence
  Synthetic oligonucleotide
cugccagugaaguggauggcuuugg

SEQ ID NO: 1373 - RNA, 25 nt, Artificial Sequence
  Synthetic oligonucleotide
guggauggcuuuggaaagucugcaa

SEQ ID NO: 1374 - RNA, 25 nt, Artificial Sequence
  Synthetic oligonucleotide
ggauggcuuuggaaagucugcaaac

SEQ ID NO: 1375 - RNA, 25 nt, Artificial Sequence
  Synthetic oligonucleotide
uuuggaaagucugcaaacucaaaag

SEQ ID NO: 1376 - RNA, 25 nt, Artificial Sequence
  Synthetic oligonucleotide
cuuuggcgugcuccucugggagcug

SEQ ID NO: 1377 - RNA, 25 nt, Artificial Sequence
  Synthetic oligonucleotide
uuggcgugcuccucugggagcugau

SEQ ID NO: 1378 - RNA, 25 nt, Artificial Sequence
  Synthetic oligonucleotide
uggcgugcuccucugggagcugaug

SEQ ID NO: 1379 - RNA, 25 nt, Artificial Sequence
  Synthetic oligonucleotide
ggcgugcuccucugggagcugauga

SEQ ID NO: 1380 - RNA, 25 nt, Artificial Sequence
  Synthetic oligonucleotide
gcgugcuccucugggagcugaugac

SEQ ID NO: 1381 - RNA, 25 nt, Artificial Sequence
  Synthetic oligonucleotide
gugaacgcuacuuaugugaacguaa

SEQ ID NO: 1382 - RNA, 25 nt, Artificial Sequence
  Synthetic oligonucleotide
ugaacgcuacuuaugugaacguaaa

SEQ ID NO: 1383 - RNA, 25 nt, Artificial Sequence
  Synthetic oligonucleotide
cuguugucaucagaagauaacgcug

SEQ ID NO: 1384 - RNA, 25 nt, Artificial Sequence
  Synthetic oligonucleotide
uugcucuugccaaaauugcacuauu

SEQ ID NO: 1385 - RNA, 25 nt, Artificial Sequence
  Synthetic oligonucleotide
auuguuauuuaaauuacuggauucu

SEQ ID NO: 1386 - RNA, 25 nt, Artificial Sequence
  Synthetic oligonucleotide
cuggauucuaaggaauuucuuaucu

SEQ ID NO: 1387 - RNA, 25 nt, Artificial Sequence
  Synthetic oligonucleotide
uggauucuaaggaauuucuuaucug

SEQ ID NO: 1388 - RNA, 25 nt, Artificial Sequence
  Synthetic oligonucleotide
gguugaauuuuuuaaaaaucaggua

SEQ ID NO: 1389 - RNA, 25 nt, Artificial Sequence
  Synthetic oligonucleotide
aaacauucccuuuuaaauguuuguu

SEQ ID NO: 1390 - RNA, 25 nt, Artificial Sequence
  Synthetic oligonucleotide
uuaaauguuuguuuguuuuuugaga

SEQ ID NO: 1391 - RNA, 25 nt, Artificial Sequence
  Synthetic oligonucleotide
ggaucucacucuguugccagggcug

SEQ ID NO: 1392 - RNA, 25 nt, Artificial Sequence
  Synthetic oligonucleotide
aucucacucuguugccagggcugua

SEQ ID NO: 1393 - RNA, 25 nt, Artificial Sequence
  Synthetic oligonucleotide
cacucuguugccagggcuguagugc

SEQ ID NO: 1394 - RNA, 25 nt, Artificial Sequence
  Synthetic oligonucleotide
cucuguugccagggcuguagugcag

SEQ ID NO: 1395 - RNA, 25 nt, Artificial Sequence
  Synthetic oligonucleotide
guugccagggcuguagugcaguggu

SEQ ID NO: 1396 - RNA, 25 nt, Artificial Sequence
  Synthetic oligonucleotide
cuguagugcaguggugugaucauag

SEQ ID NO: 1397 - RNA, 25 nt, Artificial Sequence
  Synthetic oligonucleotide
gcaguggugugaucauagcucacug

SEQ ID NO: 1398 - RNA, 25 nt, Artificial Sequence
  Synthetic oligonucleotide
ggcuaauuuuuguauuuuuuguaga

SEQ ID NO: 1399 - RNA, 25 nt, Artificial Sequence
  Synthetic oligonucleotide
uuauaaauuuuuguauagacauucc

SEQ ID NO: 1400 - RNA, 25 nt, Artificial Sequence
  Synthetic oligonucleotide
uggaagaauauuuauaggcaauaca

SEQ ID NO: 1401 - RNA, 25 nt, Artificial Sequence
  Synthetic oligonucleotide
cacaaaacauguuuauaaaugaaca

SEQ ID NO: 1402 - RNA, 25 nt, Artificial Sequence
  Synthetic oligonucleotide
gacauuaagaaaauuuguaugaaau

SEQ ID NO: 1403 - RNA, 25 nt, Artificial Sequence
  Synthetic oligonucleotide
guguguauuuuuuuaaaugaaaacu

SEQ ID NO: 1404 - RNA, 25 nt, Artificial Sequence
  Synthetic oligonucleotide
cucagcauguuuguaaagcaggaua

SEQ ID NO: 1405 - RNA, 25 nt, Artificial Sequence
  Synthetic oligonucleotide
gauggauugaaaagauuagccucug

SEQ ID NO: 1406 - RNA, 25 nt, Artificial Sequence
  Synthetic oligonucleotide
ucuguggaauuuugugcuugcuacu

SEQ ID NO: 1407 - RNA, 25 nt, Artificial Sequence
  Synthetic oligonucleotide
cuguggaauuuugugcuugcuacug

SEQ ID NO: 1408 - RNA, 25 nt, Artificial Sequence
  Synthetic oligonucleotide
guggaauuuugugcuugcuacugua

SEQ ID NO: 1409 - RNA, 25 nt, Artificial Sequence
  Synthetic oligonucleotide
gaauuuugugcuugcuacuguauag

SEQ ID NO: 1410 - RNA, 25 nt, Artificial Sequence
  Synthetic oligonucleotide
uuuugugcuugcuacuguauagugc

SEQ ID NO: 1411 - RNA, 25 nt, Artificial Sequence
  Synthetic oligonucleotide
uugugcuugcuacuguauagugcau

SEQ ID NO: 1412 - RNA, 25 nt, Artificial Sequence
  Synthetic oligonucleotide
ugugcuugcuacuguauagugcaug

SEQ ID NO: 1413 - RNA, 25 nt, Artificial Sequence
  Synthetic oligonucleotide
gugcuugcuacuguauagugcaugu

SEQ ID NO: 1414 - RNA, 25 nt, Artificial Sequence
  Synthetic oligonucleotide
ugcuugcuacuguauagugcaugug

SEQ ID NO: 1415 - RNA, 25 nt, Artificial Sequence
  Synthetic oligonucleotide
gcuugcuacuguauagugcaugugg

SEQ ID NO: 1416 - RNA, 25 nt, Artificial Sequence
  Synthetic oligonucleotide
uugcuacuguauagugcauguggug

SEQ ID NO: 1417 - RNA, 25 nt, Artificial Sequence
  Synthetic oligonucleotide
gcuacuguauagugcauguggugua

SEQ ID NO: 1418 - RNA, 25 nt, Artificial Sequence
  Synthetic oligonucleotide
cuacuguauagugcaugugguguag

SEQ ID NO: 1419 - RNA, 25 nt, Artificial Sequence
  Synthetic oligonucleotide
uacuguauagugcaugugguguagg

SEQ ID NO: 1420 - RNA, 25 nt, Artificial Sequence
  Synthetic oligonucleotide
aacauuuaaaguguuauauuuuuua

SEQ ID NO: 1421 - RNA, 25 nt, Artificial Sequence
  Synthetic oligonucleotide
aaaauguuuauuuuuaaugauauga

SEQ ID NO: 1422 - RNA, 25 nt, Artificial Sequence
  Synthetic oligonucleotide
aaauguuuauuuuuaaugauaugag

SEQ ID NO: 1423 - RNA, 25 nt, Artificial Sequence
  Synthetic oligonucleotide
aauguuuauuuuuaaugauaugaga

SEQ ID NO: 1424 - RNA, 25 nt, Artificial Sequence
  Synthetic oligonucleotide
acugugaacauuuuagaaaagguau

SEQ ID NO: 1425 - RNA, 25 nt, Artificial Sequence
  Synthetic oligonucleotide
gauaaggaaauguacugauugccaa

SEQ ID NO: 1426 - RNA, 25 nt, Artificial Sequence
  Synthetic oligonucleotide
auaaggaaauguacugauugccaau

SEQ ID NO: 1427 - RNA, 25 nt, Artificial Sequence
  Synthetic oligonucleotide
uaaggaaauguacugauugccaaua

SEQ ID NO: 1428 - RNA, 25 nt, Artificial Sequence
  Synthetic oligonucleotide
aaggaaauguacugauugccaauac

SEQ ID NO: 1429 - RNA, 25 nt, Artificial Sequence
  Synthetic oligonucleotide
aggaaauguacugauugccaauaca

SEQ ID NO: 1430 - RNA, 25 nt, Artificial Sequence
  Synthetic oligonucleotide
ggaaauguacugauugccaauacac

SEQ ID NO: 1431 - RNA, 25 nt, Artificial Sequence
  Synthetic oligonucleotide
caggacuugaagccaaggguuaacc

SEQ ID NO: 1432 - RNA, 25 nt, Artificial Sequence
  Synthetic oligonucleotide
aggacuugaagccaaggguuaaccc

SEQ ID NO: 1433 - RNA, 25 nt, Artificial Sequence
  Synthetic oligonucleotide
ggacuugaagccaaggguuaaccca

SEQ ID NO: 1434 - RNA, 25 nt, Artificial Sequence
  Synthetic oligonucleotide
gacuugaagccaaggguuaacccag

SEQ ID NO: 1435 - RNA, 25 nt, Artificial Sequence
  Synthetic oligonucleotide
acuugaagccaaggguuaacccagc

SEQ ID NO: 1436 - RNA, 25 nt, Artificial Sequence
  Synthetic oligonucleotide
ccguuucauaaauguaauaaguaau

SEQ ID NO: 1437 - RNA, 25 nt, Artificial Sequence
  Synthetic oligonucleotide
ugcuauuuauaaacuuguccuuaga

SEQ ID NO: 1438 - RNA, 25 nt, Artificial Sequence
  Synthetic oligonucleotide
uugucacugccuauaccugcagcug

SEQ ID NO: 1439 - RNA, 25 nt, Artificial Sequence
  Synthetic oligonucleotide
ugucacugccuauaccugcagcuga

SEQ ID NO: 1440 - RNA, 25 nt, Artificial Sequence
  Synthetic oligonucleotide
gucacugccuauaccugcagcugaa

SEQ ID NO: 1441 - RNA, 21 nt, Artificial Sequence
  Synthetic oligonucleotide
ggcgcggagcgcgcguguggu

SEQ ID NO: 1442 - RNA, 21 nt, Artificial Sequence
  Synthetic oligonucleotide
gcgcggagcgcgcgugugguc

SEQ ID NO: 1443 - RNA, 21 nt, Artificial Sequence
  Synthetic oligonucleotide
cgcggagcgcgcguguggucc

SEQ ID NO: 1444 - RNA, 21 nt, Artificial Sequence
  Synthetic oligonucleotide
cggagcgcgcgugugguccuu

SEQ ID NO: 1445 - RNA, 21 nt, Artificial Sequence
  Synthetic oligonucleotide
gagcgcgcgugugguccuugc

SEQ ID NO: 1446 - RNA, 21 nt, Artificial Sequence
  Synthetic oligonucleotide
agcgcgcgugugguccuugcg

SEQ ID NO: 1447 - RNA, 21 nt, Artificial Sequence
  Synthetic oligonucleotide
cgcgcgugugguccuugcgcc

SEQ ID NO: 1448 - RNA, 21 nt, Artificial Sequence
  Synthetic oligonucleotide
gcgcgugugguccuugcgccg

SEQ ID NO: 1449 - RNA, 21 nt, Artificial Sequence
  Synthetic oligonucleotide
gcgugugguccuugcgccgcu

SEQ ID NO: 1450 - RNA, 21 nt, Artificial Sequence
  Synthetic oligonucleotide
guccuugcgccgcugacuucu

SEQ ID NO: 1451 - RNA, 21 nt, Artificial Sequence
  Synthetic oligonucleotide
uugcgccgcugacuucuccac

SEQ ID NO: 1452 - RNA, 21 nt, Artificial Sequence
  Synthetic oligonucleotide
cgcugugcuugcaccuggcau

SEQ ID NO: 1453 - RNA, 21 nt, Artificial Sequence
  Synthetic oligonucleotide
cugugcuugcaccuggcaucc

SEQ ID NO: 1454 - RNA, 21 nt, Artificial Sequence
  Synthetic oligonucleotide
ugcaccuggcauccucgugcu

SEQ ID NO: 1455 - RNA, 21 nt, Artificial Sequence
  Synthetic oligonucleotide
uccucgugcuccuguuuaccu

SEQ ID NO: 1456 - RNA, 21 nt, Artificial Sequence
  Synthetic oligonucleotide
ucgugcuccuguuuaccuugg

SEQ ID NO: 1457 - RNA, 21 nt, Artificial Sequence
  Synthetic oligonucleotide
cgugcuccuguuuaccuuggu

SEQ ID NO: 1458 - RNA, 21 nt, Artificial Sequence
  Synthetic oligonucleotide
gccacuaacuacauuuauguu

SEQ ID NO: 1459 - RNA, 21 nt, Artificial Sequence
  Synthetic oligonucleotide
cuaacuacauuuauguuuuaa

SEQ ID NO: 1460 - RNA, 21 nt, Artificial Sequence
  Synthetic oligonucleotide
uaacuacauuuauguuuuaaa

SEQ ID NO: 1461 - RNA, 21 nt, Artificial Sequence
  Synthetic oligonucleotide
aacuacauuuauguuuuaaau

SEQ ID NO: 1462 - RNA, 21 nt, Artificial Sequence
  Synthetic oligonucleotide
acuacauuuauguuuuaaaug

SEQ ID NO: 1463 - RNA, 21 nt, Artificial Sequence
  Synthetic oligonucleotide
cuacauuuauguuuuaaauga

SEQ ID NO: 1464 - RNA, 21 nt, Artificial Sequence
  Synthetic oligonucleotide
gcuggaacacccagauuguuu

SEQ ID NO: 1465 - RNA, 21 nt, Artificial Sequence
  Synthetic oligonucleotide
caggacugcagcagcaaagcc

SEQ ID NO: 1466 - RNA, 21 nt, Artificial Sequence
  Synthetic oligonucleotide
aggacugcagcagcaaagcca

SEQ ID NO: 1467 - RNA, 21 nt, Artificial Sequence
  Synthetic oligonucleotide
ggacugcagcagcaaagccaa

SEQ ID NO: 1468 - RNA, 21 nt, Artificial Sequence
  Synthetic oligonucleotide
gacugcagcagcaaagccaau

SEQ ID NO: 1469 - RNA, 21 nt, Artificial Sequence
  Synthetic oligonucleotide
acugcagcagcaaagccaauu

SEQ ID NO: 1470 - RNA, 21 nt, Artificial Sequence
  Synthetic oligonucleotide
ccuacuaugaugaucaacuca

SEQ ID NO: 1471 - RNA, 21 nt, Artificial Sequence
  Synthetic oligonucleotide
cuacuaugaugaucaacucau

SEQ ID NO: 1472 - RNA, 21 nt, Artificial Sequence
  Synthetic oligonucleotide
uacuaugaugaucaacucauu

SEQ ID NO: 1473 - RNA, 21 nt, Artificial Sequence
  Synthetic oligonucleotide
acuaugaugaucaacucauua

SEQ ID NO: 1474 - RNA, 21 nt, Artificial Sequence
  Synthetic oligonucleotide
cuaugaugaucaacucauuag

SEQ ID NO: 1475 - RNA, 21 nt, Artificial Sequence
  Synthetic oligonucleotide
uaugaugaucaacucauuagc

SEQ ID NO: 1476 - RNA, 21 nt, Artificial Sequence
  Synthetic oligonucleotide
augaugaucaacucauuagcu

SEQ ID NO: 1477 - RNA, 21 nt, Artificial Sequence
  Synthetic oligonucleotide
ugaugaucaacucauuagcug

SEQ ID NO: 1478 - RNA, 21 nt, Artificial Sequence
  Synthetic oligonucleotide
gaugaucaacucauuagcugu

SEQ ID NO: 1479 - RNA, 21 nt, Artificial Sequence
  Synthetic oligonucleotide
augaucaacucauuagcugug

SEQ ID NO: 1480 - RNA, 21 nt, Artificial Sequence
  Synthetic oligonucleotide
ugaucaacucauuagcugugg

SEQ ID NO: 1481 - RNA, 21 nt, Artificial Sequence
  Synthetic oligonucleotide
gaucaacucauuagcuguggc

SEQ ID NO: 1482 - RNA, 21 nt, Artificial Sequence
  Synthetic oligonucleotide
aucaacucauuagcuguggca

SEQ ID NO: 1483 - RNA, 21 nt, Artificial Sequence
  Synthetic oligonucleotide
ucaacucauuagcuguggcag

SEQ ID NO: 1484 - RNA, 21 nt, Artificial Sequence
  Synthetic oligonucleotide
aagaugguuuuauguuuuuga

SEQ ID NO: 1485 - RNA, 21 nt, Artificial Sequence
  Synthetic oligonucleotide
gccuuugaaagcaacaauuuu

SEQ ID NO: 1486 - RNA, 21 nt, Artificial Sequence
  Synthetic oligonucleotide
agggaaacucuagaugcucag

SEQ ID NO: 1487 - RNA, 21 nt, Artificial Sequence
  Synthetic oligonucleotide
gggaaacucuagaugcucaga

SEQ ID NO: 1488 - RNA, 21 nt, Artificial Sequence
  Synthetic oligonucleotide
ggaaacucuagaugcucagac

SEQ ID NO: 1489 - RNA, 21 nt, Artificial Sequence
  Synthetic oligonucleotide
gaaacucuagaugcucagacu

SEQ ID NO: 1490 - RNA, 21 nt, Artificial Sequence
  Synthetic oligonucleotide
aaacucuagaugcucagacuu

SEQ ID NO: 1491 - RNA, 21 nt, Artificial Sequence
  Synthetic oligonucleotide
aacucuagaugcucagacuuu

SEQ ID NO: 1492 - RNA, 21 nt, Artificial Sequence
  Synthetic oligonucleotide
cacacaagaauaaucagguuc

SEQ ID NO: 1493 - RNA, 21 nt, Artificial Sequence
  Synthetic oligonucleotide
cacaagaauaaucagguucug

SEQ ID NO: 1494 - RNA, 21 nt, Artificial Sequence
  Synthetic oligonucleotide
acaagaauaaucagguucugu

SEQ ID NO: 1495 - RNA, 21 nt, Artificial Sequence
  Synthetic oligonucleotide
caagaauaaucagguucuguu

SEQ ID NO: 1496 - RNA, 21 nt, Artificial Sequence
  Synthetic oligonucleotide
aagaauaaucagguucuguuc

SEQ ID NO: 1497 - RNA, 21 nt, Artificial Sequence
  Synthetic oligonucleotide
agaauaaucagguucuguucc

SEQ ID NO: 1498 - RNA, 21 nt, Artificial Sequence
  Synthetic oligonucleotide
cuguuccauaaacucuggauu

SEQ ID NO: 1499 - RNA, 21 nt, Artificial Sequence
  Synthetic oligonucleotide
cuggaguguauucucacagaa

SEQ ID NO: 1500 - RNA, 21 nt, Artificial Sequence
  Synthetic oligonucleotide
aaggaaguguuuaauauacuu

SEQ ID NO: 1501 - RNA, 21 nt, Artificial Sequence
  Synthetic oligonucleotide
uucaggcugcguaugucagca

SEQ ID NO: 1502 - RNA, 21 nt, Artificial Sequence
  Synthetic oligonucleotide
ucgcacaaagcaagccagauu

SEQ ID NO: 1503 - RNA, 21 nt, Artificial Sequence
  Synthetic oligonucleotide
cgcacaaagcaagccagauuc

SEQ ID NO: 1504 - RNA, 21 nt, Artificial Sequence
  Synthetic oligonucleotide
gcacaaagcaagccagauucu

SEQ ID NO: 1505 - RNA, 21 nt, Artificial Sequence
  Synthetic oligonucleotide
cacaaagcaagccagauucug

SEQ ID NO: 1506 - RNA, 21 nt, Artificial Sequence
  Synthetic oligonucleotide
acaaagcaagccagauucugc

SEQ ID NO: 1507 - RNA, 21 nt, Artificial Sequence
  Synthetic oligonucleotide
augugagaugucuccagcauu

SEQ ID NO: 1508 - RNA, 21 nt, Artificial Sequence
  Synthetic oligonucleotide
ugugagaugucuccagcauuu

SEQ ID NO: 1509 - RNA, 21 nt, Artificial Sequence
  Synthetic oligonucleotide
gugagaugucuccagcauuuu

SEQ ID NO: 1510 - RNA, 21 nt, Artificial Sequence
  Synthetic oligonucleotide
ugagaugucuccagcauuuuu

SEQ ID NO: 1511 - RNA, 21 nt, Artificial Sequence
  Synthetic oligonucleotide
gagaugucuccagcauuuuua

SEQ ID NO: 1512 - RNA, 21 nt, Artificial Sequence
  Synthetic oligonucleotide
agaugucuccagcauuuuuac

SEQ ID NO: 1513 - RNA, 21 nt, Artificial Sequence
  Synthetic oligonucleotide
gaugucuccagcauuuuuacg

SEQ ID NO: 1514 - RNA, 21 nt, Artificial Sequence
  Synthetic oligonucleotide
augucuccagcauuuuuacgg

SEQ ID NO: 1515 - RNA, 21 nt, Artificial Sequence
  Synthetic oligonucleotide
ugucuccagcauuuuuacgga

SEQ ID NO: 1516 - RNA, 21 nt, Artificial Sequence
  Synthetic oligonucleotide
gucuccagcauuuuuacggac

SEQ ID NO: 1517 - RNA, 21 nt, Artificial Sequence
  Synthetic oligonucleotide
ucuccagcauuuuuacggacc

SEQ ID NO: 1518 - RNA, 21 nt, Artificial Sequence
  Synthetic oligonucleotide
cuccagcauuuuuacggaccc

SEQ ID NO: 1519 - RNA, 21 nt, Artificial Sequence
  Synthetic oligonucleotide
uccagcauuuuuacggaccca

SEQ ID NO: 1520 - RNA, 21 nt, Artificial Sequence
  Synthetic oligonucleotide
ccagcauuuuuacggacccaa

SEQ ID NO: 1521 - RNA, 21 nt, Artificial Sequence
  Synthetic oligonucleotide
aguuuaccacagcuuugcagc

SEQ ID NO: 1522 - RNA, 21 nt, Artificial Sequence
  Synthetic oligonucleotide
uuuaccacagcuuugcagcgc

SEQ ID NO: 1523 - RNA, 21 nt, Artificial Sequence
  Synthetic oligonucleotide
uaccacagcuuugcagcgcgu

SEQ ID NO: 1524 - RNA, 21 nt, Artificial Sequence
  Synthetic oligonucleotide
accacagcuuugcagcgcguu

SEQ ID NO: 1525 - RNA, 21 nt, Artificial Sequence
  Synthetic oligonucleotide
cacagcuuugcagcgcguuga

SEQ ID NO: 1526 - RNA, 21 nt, Artificial Sequence
  Synthetic oligonucleotide
cagcuuugcagcgcguugacu

SEQ ID NO: 1527 - RNA, 21 nt, Artificial Sequence
  Synthetic oligonucleotide
agcuuugcagcgcguugacuu

SEQ ID NO: 1528 - RNA, 21 nt, Artificial Sequence
  Synthetic oligonucleotide
gcuuugcagcgcguugacuua

SEQ ID NO: 1529 - RNA, 21 nt, Artificial Sequence
  Synthetic oligonucleotide
cuuugcagcgcguugacuuau

SEQ ID NO: 1530 - RNA, 21 nt, Artificial Sequence
  Synthetic oligonucleotide
gcugaccauauguggcuggga

SEQ ID NO: 1531 - RNA, 21 nt, Artificial Sequence
  Synthetic oligonucleotide
cugaccauauguggcugggac

SEQ ID NO: 1532 - RNA, 21 nt, Artificial Sequence
  Synthetic oligonucleotide
ugaccauauguggcugggacu

SEQ ID NO: 1533 - RNA, 21 nt, Artificial Sequence
  Synthetic oligonucleotide
gaccauauguggcugggacuu

SEQ ID NO: 1534 - RNA, 21 nt, Artificial Sequence
  Synthetic oligonucleotide
accauauguggcugggacuuu

SEQ ID NO: 1535 - RNA, 21 nt, Artificial Sequence
  Synthetic oligonucleotide
ccauauguggcugggacuuug

SEQ ID NO: 1536 - RNA, 21 nt, Artificial Sequence
  Synthetic oligonucleotide
cauauguggcugggacuuugg

SEQ ID NO: 1537 - RNA, 21 nt, Artificial Sequence
  Synthetic oligonucleotide
auauguggcugggacuuugga

SEQ ID NO: 1538 - RNA, 21 nt, Artificial Sequence
  Synthetic oligonucleotide
uauguggcugggacuuuggau

SEQ ID NO: 1539 - RNA, 21 nt, Artificial Sequence
  Synthetic oligonucleotide
auguggcugggacuuuggauu

SEQ ID NO: 1540 - RNA, 21 nt, Artificial Sequence
  Synthetic oligonucleotide
uucggaggaauaauaaauuug

SEQ ID NO: 1541 - RNA, 21 nt, Artificial Sequence
  Synthetic oligonucleotide
aggaauaauaaauuugauuua

SEQ ID NO: 1542 - RNA, 21 nt, Artificial Sequence
  Synthetic oligonucleotide
ggaauaauaaauuugauuuaa

SEQ ID NO: 1543 - RNA, 21 nt, Artificial Sequence
  Synthetic oligonucleotide
cauugaaaugcacaguugguc

SEQ ID NO: 1544 - RNA, 21 nt, Artificial Sequence
  Synthetic oligonucleotide
auugaaaugcacaguuggucc

SEQ ID NO: 1545 - RNA, 21 nt, Artificial Sequence
  Synthetic oligonucleotide
uucaauauguccauaauuauu

SEQ ID NO: 1546 - RNA, 21 nt, Artificial Sequence
  Synthetic oligonucleotide
gguggaaaaacauguacuuua

SEQ ID NO: 1547 - RNA, 21 nt, Artificial Sequence
  Synthetic oligonucleotide
uguaccacuccuucccugcaa

SEQ ID NO: 1548 - RNA, 21 nt, Artificial Sequence
  Synthetic oligonucleotide
uaagccuuuugaaaagccagu

SEQ ID NO: 1549 - RNA, 21 nt, Artificial Sequence
  Synthetic oligonucleotide
ugauauugacccugaagcagu

SEQ ID NO: 1550 - RNA, 21 nt, Artificial Sequence
  Synthetic oligonucleotide
gauauugacccugaagcaguu

SEQ ID NO: 1551 - RNA, 21 nt, Artificial Sequence
  Synthetic oligonucleotide
auauugacccugaagcaguua

SEQ ID NO: 1552 - RNA, 21 nt, Artificial Sequence
  Synthetic oligonucleotide
uauugacccugaagcaguuaa

SEQ ID NO: 1553 - RNA, 21 nt, Artificial Sequence
  Synthetic oligonucleotide
auugacccugaagcaguuaaa

SEQ ID NO: 1554 - RNA, 21 nt, Artificial Sequence
  Synthetic oligonucleotide
uugacccugaagcaguuaaag

SEQ ID NO: 1555 - RNA, 21 nt, Artificial Sequence
  Synthetic oligonucleotide
ugacccugaagcaguuaaagg

SEQ ID NO: 1556 - RNA, 21 nt, Artificial Sequence
  Synthetic oligonucleotide
gacccugaagcaguuaaaggu

SEQ ID NO: 1557 - RNA, 21 nt, Artificial Sequence
  Synthetic oligonucleotide
acccugaagcaguuaaaggug

SEQ ID NO: 1558 - RNA, 21 nt, Artificial Sequence
  Synthetic oligonucleotide
cccugaagcaguuaaagguga

SEQ ID NO: 1559 - RNA, 21 nt, Artificial Sequence
  Synthetic oligonucleotide
ccugaagcaguuaaaggugaa

SEQ ID NO: 1560 - RNA, 21 nt, Artificial Sequence
  Synthetic oligonucleotide
cugaagcaguuaaaggugaag

SEQ ID NO: 1561 - RNA, 21 nt, Artificial Sequence
  Synthetic oligonucleotide
ugaagcaguuaaaggugaagu

SEQ ID NO: 1562 - RNA, 21 nt, Artificial Sequence
  Synthetic oligonucleotide
gaagcaguuaaaggugaagug

SEQ ID NO: 1563 - RNA, 21 nt, Artificial Sequence
  Synthetic oligonucleotide
aagcaguuaaaggugaagugu

SEQ ID NO: 1564 - RNA, 21 nt, Artificial Sequence
  Synthetic oligonucleotide
agcaguuaaaggugaaguguu

SEQ ID NO: 1565 - RNA, 21 nt, Artificial Sequence
  Synthetic oligonucleotide
gcaguuaaaggugaaguguua

SEQ ID NO: 1566 - RNA, 21 nt, Artificial Sequence
  Synthetic oligonucleotide
caguuaaaggugaaguguuaa

SEQ ID NO: 1567 - RNA, 21 nt, Artificial Sequence
  Synthetic oligonucleotide
aguuaaaggugaaguguuaaa

SEQ ID NO: 1568 - RNA, 21 nt, Artificial Sequence
  Synthetic oligonucleotide
guuaaaggugaaguguuaaaa

SEQ ID NO: 1569 - RNA, 21 nt, Artificial Sequence
  Synthetic oligonucleotide
uuaaaggugaaguguuaaaag

SEQ ID NO: 1570 - RNA, 21 nt, Artificial Sequence
  Synthetic oligonucleotide
uaaaggugaaguguuaaaagu

SEQ ID NO: 1571 - RNA, 21 nt, Artificial Sequence
  Synthetic oligonucleotide
aaaggugaaguguuaaaaguu

SEQ ID NO: 1572 - RNA, 21 nt, Artificial Sequence
  Synthetic oligonucleotide
aaggugaaguguuaaaaguug

SEQ ID NO: 1573 - RNA, 21 nt, Artificial Sequence
  Synthetic oligonucleotide
aggugaaguguuaaaaguugg

SEQ ID NO: 1574 - RNA, 21 nt, Artificial Sequence
  Synthetic oligonucleotide
ggugaaguguuaaaaguugga

SEQ ID NO: 1575 - RNA, 21 nt, Artificial Sequence
  Synthetic oligonucleotide
gugaaguguuaaaaguuggaa

SEQ ID NO: 1576 - RNA, 21 nt, Artificial Sequence
  Synthetic oligonucleotide
ugaaguguuaaaaguuggaaa

SEQ ID NO: 1577 - RNA, 21 nt, Artificial Sequence
  Synthetic oligonucleotide
gaaguguuaaaaguuggaaau

SEQ ID NO: 1578 - RNA, 21 nt, Artificial Sequence
  Synthetic oligonucleotide
auugaacagcgagcuaaauau

SEQ ID NO: 1579 - RNA, 21 nt, Artificial Sequence
  Synthetic oligonucleotide
uugaacagcgagcuaaauaua

SEQ ID NO: 1580 - RNA, 21 nt, Artificial Sequence
  Synthetic oligonucleotide
ugaacagcgagcuaaauauag

SEQ ID NO: 1581 - RNA, 21 nt, Artificial Sequence
  Synthetic oligonucleotide
gaacagcgagcuaaauauaga

SEQ ID NO: 1582 - RNA, 21 nt, Artificial Sequence
  Synthetic oligonucleotide
aacagcgagcuaaauauagag

SEQ ID NO: 1583 - RNA, 21 nt, Artificial Sequence
  Synthetic oligonucleotide
acagcgagcuaaauauagagu

SEQ ID NO: 1584 - RNA, 21 nt, Artificial Sequence
  Synthetic oligonucleotide
cagcgagcuaaauauagagug

SEQ ID NO: 1585 - RNA, 21 nt, Artificial Sequence
  Synthetic oligonucleotide
agcgagcuaaauauagagugg

SEQ ID NO: 1586 - RNA, 21 nt, Artificial Sequence
  Synthetic oligonucleotide
gcgagcuaaauauagagugga

SEQ ID NO: 1587 - RNA, 21 nt, Artificial Sequence
  Synthetic oligonucleotide
cgagcuaaauauagaguggaa

SEQ ID NO: 1588 - RNA, 21 nt, Artificial Sequence
  Synthetic oligonucleotide
gagcuaaauauagaguggaag

SEQ ID NO: 1589 - RNA, 21 nt, Artificial Sequence
  Synthetic oligonucleotide
agcuaaauauagaguggaagc

SEQ ID NO: 1590 - RNA, 21 nt, Artificial Sequence
  Synthetic oligonucleotide
gcuaaauauagaguggaagca

SEQ ID NO: 1591 - RNA, 21 nt, Artificial Sequence
  Synthetic oligonucleotide
cuaaauauagaguggaagcaa

SEQ ID NO: 1592 - RNA, 21 nt, Artificial Sequence
  Synthetic oligonucleotide
uaaauauagaguggaagcaag

SEQ ID NO: 1593 - RNA, 21 nt, Artificial Sequence
  Synthetic oligonucleotide
aaauauagaguggaagcaagc

SEQ ID NO: 1594 - RNA, 21 nt, Artificial Sequence
  Synthetic oligonucleotide
aauauagaguggaagcaagca

SEQ ID NO: 1595 - RNA, 21 nt, Artificial Sequence
  Synthetic oligonucleotide
cuuggguuuuuccuguggcug

SEQ ID NO: 1596 - RNA, 21 nt, Artificial Sequence
  Synthetic oligonucleotide
guggcugaaaaagagaaagca

SEQ ID NO: 1597 - RNA, 21 nt, Artificial Sequence
  Synthetic oligonucleotide
auuaaagaucugggcagugaa

SEQ ID NO: 1598 - RNA, 21 nt, Artificial Sequence
  Synthetic oligonucleotide
uuaaagaucugggcagugaau

SEQ ID NO: 1599 - RNA, 21 nt, Artificial Sequence
  Synthetic oligonucleotide
uaaagaucugggcagugaauu

SEQ ID NO: 1600 - RNA, 21 nt, Artificial Sequence
  Synthetic oligonucleotide
aaagaucugggcagugaauua

SEQ ID NO: 1601 - RNA, 21 nt, Artificial Sequence
  Synthetic oligonucleotide
aagaucugggcagugaauuag

SEQ ID NO: 1602 - RNA, 21 nt, Artificial Sequence
  Synthetic oligonucleotide
agaucugggcagugaauuagu

SEQ ID NO: 1603 - RNA, 21 nt, Artificial Sequence
  Synthetic oligonucleotide
gaucugggcagugaauuaguu

SEQ ID NO: 1604 - RNA, 21 nt, Artificial Sequence
  Synthetic oligonucleotide
aucugggcagugaauuaguuc

SEQ ID NO: 1605 - RNA, 21 nt, Artificial Sequence
  Synthetic oligonucleotide
ucugggcagugaauuaguucg

SEQ ID NO: 1606 - RNA, 21 nt, Artificial Sequence
  Synthetic oligonucleotide
cugggcagugaauuaguucgc

SEQ ID NO: 1607 - RNA, 21 nt, Artificial Sequence
  Synthetic oligonucleotide
ugggcagugaauuaguucgcu

SEQ ID NO: 1608 - RNA, 21 nt, Artificial Sequence
  Synthetic oligonucleotide
gggcagugaauuaguucgcua

SEQ ID NO: 1609 - RNA, 21 nt, Artificial Sequence
  Synthetic oligonucleotide
cacacuccucauuuggauagg

SEQ ID NO: 1610 - RNA, 21 nt, Artificial Sequence
  Synthetic oligonucleotide
acacuccucauuuggauaggc

SEQ ID NO: 1611 - RNA, 21 nt, Artificial Sequence
  Synthetic oligonucleotide
cacuccucauuuggauaggcu

SEQ ID NO: 1612 - RNA, 21 nt, Artificial Sequence
  Synthetic oligonucleotide
acuccucauuuggauaggcuu

SEQ ID NO: 1613 - RNA, 21 nt, Artificial Sequence
  Synthetic oligonucleotide
cuccucauuuggauaggcuug

SEQ ID NO: 1614 - RNA, 21 nt, Artificial Sequence
  Synthetic oligonucleotide
uccucauuuggauaggcuugu

SEQ ID NO: 1615 - RNA, 21 nt, Artificial Sequence
  Synthetic oligonucleotide
ccucauuuggauaggcuugua

SEQ ID NO: 1616 - RNA, 21 nt, Artificial Sequence
  Synthetic oligonucleotide
cucauuuggauaggcuuguaa

SEQ ID NO: 1617 - RNA, 21 nt, Artificial Sequence
  Synthetic oligonucleotide
ucauuuggauaggcuuguaag

SEQ ID NO: 1618 - RNA, 21 nt, Artificial Sequence
  Synthetic oligonucleotide
cauuuggauaggcuuguaagu

SEQ ID NO: 1619 - RNA, 21 nt, Artificial Sequence
  Synthetic oligonucleotide
auuuggauaggcuuguaagug

SEQ ID NO: 1620 - RNA, 21 nt, Artificial Sequence
  Synthetic oligonucleotide
uuuggauaggcuuguaagugc

SEQ ID NO: 1621 - RNA, 21 nt, Artificial Sequence
  Synthetic oligonucleotide
uuggauaggcuuguaagugcc

SEQ ID NO: 1622 - RNA, 21 nt, Artificial Sequence
  Synthetic oligonucleotide
uggauaggcuuguaagugccc

SEQ ID NO: 1623 - RNA, 21 nt, Artificial Sequence
  Synthetic oligonucleotide
ggauaggcuuguaagugcccg

SEQ ID NO: 1624 - RNA, 21 nt, Artificial Sequence
  Synthetic oligonucleotide
gauaggcuuguaagugcccga

SEQ ID NO: 1625 - RNA, 21 nt, Artificial Sequence
  Synthetic oligonucleotide
auaggcuuguaagugcccgaa

SEQ ID NO: 1626 - RNA, 21 nt, Artificial Sequence
  Synthetic oligonucleotide
uaggcuuguaagugcccgaag

SEQ ID NO: 1627 - RNA, 21 nt, Artificial Sequence
  Synthetic oligonucleotide
aggcuuguaagugcccgaagu

SEQ ID NO: 1628 - RNA, 21 nt, Artificial Sequence
  Synthetic oligonucleotide
ggcuuguaagugcccgaagug

SEQ ID NO: 1629 - RNA, 21 nt, Artificial Sequence
  Synthetic oligonucleotide
gcuuguaagugcccgaagugu

SEQ ID NO: 1630 - RNA, 21 nt, Artificial Sequence
  Synthetic oligonucleotide
cuuguaagugcccgaagugua

SEQ ID NO: 1631 - RNA, 21 nt, Artificial Sequence
  Synthetic oligonucleotide
uuguaagugcccgaaguguaa

SEQ ID NO: 1632 - RNA, 21 nt, Artificial Sequence
  Synthetic oligonucleotide
uguaagugcccgaaguguaag

SEQ ID NO: 1633 - RNA, 21 nt, Artificial Sequence
  Synthetic oligonucleotide
ccgagcuacuuuuccagaaga

SEQ ID NO: 1634 - RNA, 21 nt, Artificial Sequence
  Synthetic oligonucleotide
uccacauugaccucagugcuc

SEQ ID NO: 1635 - RNA, 21 nt, Artificial Sequence
  Synthetic oligonucleotide
ccacauugaccucagugcucu

SEQ ID NO: 1636 - RNA, 21 nt, Artificial Sequence
  Synthetic oligonucleotide
cacauugaccucagugcucua

SEQ ID NO: 1637 - RNA, 21 nt, Artificial Sequence
  Synthetic oligonucleotide
acauugaccucagugcucuaa

SEQ ID NO: 1638 - RNA, 21 nt, Artificial Sequence
  Synthetic oligonucleotide
cauugaccucagugcucuaaa

SEQ ID NO: 1639 - RNA, 21 nt, Artificial Sequence
  Synthetic oligonucleotide
auugaccucagugcucuaaau

SEQ ID NO: 1640 - RNA, 21 nt, Artificial Sequence
  Synthetic oligonucleotide
uugaccucagugcucuaaauc

SEQ ID NO: 1641 - RNA, 21 nt, Artificial Sequence
  Synthetic oligonucleotide
ugaccucagugcucuaaaucc

SEQ ID NO: 1642 - RNA, 21 nt, Artificial Sequence
  Synthetic oligonucleotide
gaccucagugcucuaaaucca

SEQ ID NO: 1643 - RNA, 21 nt, Artificial Sequence
  Synthetic oligonucleotide
accucagugcucuaaauccag

SEQ ID NO: 1644 - RNA, 21 nt, Artificial Sequence
  Synthetic oligonucleotide
ccucagugcucuaaauccaga

SEQ ID NO: 1645 - RNA, 21 nt, Artificial Sequence
  Synthetic oligonucleotide
cucagugcucuaaauccagag

SEQ ID NO: 1646 - RNA, 21 nt, Artificial Sequence
  Synthetic oligonucleotide
ucagugcucuaaauccagagc

SEQ ID NO: 1647 - RNA, 21 nt, Artificial Sequence
  Synthetic oligonucleotide
cagugcucuaaauccagagcu

SEQ ID NO: 1648 - RNA, 21 nt, Artificial Sequence
  Synthetic oligonucleotide
agugcucuaaauccagagcug

SEQ ID NO: 1649 - RNA, 21 nt, Artificial Sequence
  Synthetic oligonucleotide
gugcucuaaauccagagcugg

SEQ ID NO: 1650 - RNA, 21 nt, Artificial Sequence
  Synthetic oligonucleotide
ugcucuaaauccagagcuggu

SEQ ID NO: 1651 - RNA, 21 nt, Artificial Sequence
  Synthetic oligonucleotide
gcucuaaauccagagcugguc

SEQ ID NO: 1652 - RNA, 21 nt, Artificial Sequence
  Synthetic oligonucleotide
cucuaaauccagagcuggucc

SEQ ID NO: 1653 - RNA, 21 nt, Artificial Sequence
  Synthetic oligonucleotide
ucuaaauccagagcuggucca

SEQ ID NO: 1654 - RNA, 21 nt, Artificial Sequence
  Synthetic oligonucleotide
guagccugauugugcauuuca

SEQ ID NO: 1655 - RNA, 21 nt, Artificial Sequence
  Synthetic oligonucleotide
uagccugauugugcauuucaa

SEQ ID NO: 1656 - RNA, 21 nt, Artificial Sequence
  Synthetic oligonucleotide
agccugauugugcauuucaau

SEQ ID NO: 1657 - RNA, 21 nt, Artificial Sequence
  Synthetic oligonucleotide
gccugauugugcauuucaaug

SEQ ID NO: 1658 - RNA, 21 nt, Artificial Sequence
  Synthetic oligonucleotide
ccugauugugcauuucaauga

SEQ ID NO: 1659 - RNA, 21 nt, Artificial Sequence
  Synthetic oligonucleotide
cugauugugcauuucaaugaa

SEQ ID NO: 1660 - RNA, 21 nt, Artificial Sequence
  Synthetic oligonucleotide
ugauugugcauuucaaugaag

SEQ ID NO: 1661 - RNA, 21 nt, Artificial Sequence
  Synthetic oligonucleotide
gauugugcauuucaaugaagu

SEQ ID NO: 1662 - RNA, 21 nt, Artificial Sequence
  Synthetic oligonucleotide
auugugcauuucaaugaaguc

SEQ ID NO: 1663 - RNA, 21 nt, Artificial Sequence
  Synthetic oligonucleotide
uugugcauuucaaugaaguca

SEQ ID NO: 1664 - RNA, 21 nt, Artificial Sequence
  Synthetic oligonucleotide
ugugcauuucaaugaagucau

SEQ ID NO: 1665 - RNA, 21 nt, Artificial Sequence
  Synthetic oligonucleotide
gugcauuucaaugaagucaua

SEQ ID NO: 1666 - RNA, 21 nt, Artificial Sequence
  Synthetic oligonucleotide
ugcauuucaaugaagucauag

SEQ ID NO: 1667 - RNA, 21 nt, Artificial Sequence
  Synthetic oligonucleotide
gcauuucaaugaagucauagg

SEQ ID NO: 1668 - RNA, 21 nt, Artificial Sequence
  Synthetic oligonucleotide
cauuucaaugaagucauagga

SEQ ID NO: 1669 - RNA, 21 nt, Artificial Sequence
  Synthetic oligonucleotide
auuucaaugaagucauaggaa

SEQ ID NO: 1670 - RNA, 21 nt, Artificial Sequence
  Synthetic oligonucleotide
uuucaaugaagucauaggaag

SEQ ID NO: 1671 - RNA, 21 nt, Artificial Sequence
  Synthetic oligonucleotide
uucaaugaagucauaggaaga

SEQ ID NO: 1672 - RNA, 21 nt, Artificial Sequence
  Synthetic oligonucleotide
ucaaugaagucauaggaagag

SEQ ID NO: 1673 - RNA, 21 nt, Artificial Sequence
  Synthetic oligonucleotide
caaugaagucauaggaagagg

SEQ ID NO: 1674 - RNA, 21 nt, Artificial Sequence
  Synthetic oligonucleotide
aaugaagucauaggaagaggg

SEQ ID NO: 1675 - RNA, 21 nt, Artificial Sequence
  Synthetic oligonucleotide
augaagucauaggaagagggc

SEQ ID NO: 1676 - RNA, 21 nt, Artificial Sequence
  Synthetic oligonucleotide
ugaagucauaggaagagggca

SEQ ID NO: 1677 - RNA, 21 nt, Artificial Sequence
  Synthetic oligonucleotide
gaagucauaggaagagggcau

SEQ ID NO: 1678 - RNA, 21 nt, Artificial Sequence
  Synthetic oligonucleotide
aagucauaggaagagggcauu

SEQ ID NO: 1679 - RNA, 21 nt, Artificial Sequence
  Synthetic oligonucleotide
agucauaggaagagggcauuu

SEQ ID NO: 1680 - RNA, 21 nt, Artificial Sequence
  Synthetic oligonucleotide
gucauaggaagagggcauuuu

SEQ ID NO: 1681 - RNA, 21 nt, Artificial Sequence
  Synthetic oligonucleotide
ucauaggaagagggcauuuug

SEQ ID NO: 1682 - RNA, 21 nt, Artificial Sequence
  Synthetic oligonucleotide
gcaagaaaauucacugugcug

SEQ ID NO: 1683 - RNA, 21 nt, Artificial Sequence
  Synthetic oligonucleotide
caagaaaauucacugugcugu

SEQ ID NO: 1684 - RNA, 21 nt, Artificial Sequence
  Synthetic oligonucleotide
aagaaaauucacugugcugug

SEQ ID NO: 1685 - RNA, 21 nt, Artificial Sequence
  Synthetic oligonucleotide
agaaaauucacugugcuguga

SEQ ID NO: 1686 - RNA, 21 nt, Artificial Sequence
  Synthetic oligonucleotide
gaaaauucacugugcugugaa

SEQ ID NO: 1687 - RNA, 21 nt, Artificial Sequence
  Synthetic oligonucleotide
aaaauucacugugcugugaaa

SEQ ID NO: 1688 - RNA, 21 nt, Artificial Sequence
  Synthetic oligonucleotide
aaauucacugugcugugaaau

SEQ ID NO: 1689 - RNA, 21 nt, Artificial Sequence
  Synthetic oligonucleotide
aauucacugugcugugaaauc

SEQ ID NO: 1690 - RNA, 21 nt, Artificial Sequence
  Synthetic oligonucleotide
auucacugugcugugaaaucc

SEQ ID NO: 1691 - RNA, 21 nt, Artificial Sequence
  Synthetic oligonucleotide
uucacugugcugugaaauccu

SEQ ID NO: 1692 - RNA, 21 nt, Artificial Sequence
  Synthetic oligonucleotide
ucacugugcugugaaauccuu

SEQ ID NO: 1693 - RNA, 21 nt, Artificial Sequence
  Synthetic oligonucleotide
ccgagggaaucaucaugaaag

SEQ ID NO: 1694 - RNA, 21 nt, Artificial Sequence
  Synthetic oligonucleotide
cgagggaaucaucaugaaaga

SEQ ID NO: 1695 - RNA, 21 nt, Artificial Sequence
  Synthetic oligonucleotide
augagacucauaauccaacug

SEQ ID NO: 1696 - RNA, 21 nt, Artificial Sequence
  Synthetic oligonucleotide
ugagacucauaauccaacugu

SEQ ID NO: 1697 - RNA, 21 nt, Artificial Sequence
  Synthetic oligonucleotide
aacuguaaaagaucuuauugg

SEQ ID NO: 1698 - RNA, 21 nt, Artificial Sequence
  Synthetic oligonucleotide
uuggcuuuggucuucaaguag

SEQ ID NO: 1699 - RNA, 21 nt, Artificial Sequence
  Synthetic oligonucleotide
gucuucaaguagccaaaggca

SEQ ID NO: 1700 - RNA, 21 nt, Artificial Sequence
  Synthetic oligonucleotide
ucuucaaguagccaaaggcau

SEQ ID NO: 1701 - RNA, 21 nt, Artificial Sequence
  Synthetic oligonucleotide
cuucaaguagccaaaggcaug

SEQ ID NO: 1702 - RNA, 21 nt, Artificial Sequence
  Synthetic oligonucleotide
uucaaguagccaaaggcauga

SEQ ID NO: 1703 - RNA, 21 nt, Artificial Sequence
  Synthetic oligonucleotide
ucaaguagccaaaggcaugaa

SEQ ID NO: 1704 - RNA, 21 nt, Artificial Sequence
  Synthetic oligonucleotide
caaguagccaaaggcaugaaa

SEQ ID NO: 1705 - RNA, 21 nt, Artificial Sequence
  Synthetic oligonucleotide
aaguagccaaaggcaugaaau

SEQ ID NO: 1706 - RNA, 21 nt, Artificial Sequence
  Synthetic oligonucleotide
aguagccaaaggcaugaaaua

SEQ ID NO: 1707 - RNA, 21 nt, Artificial Sequence
  Synthetic oligonucleotide
guagccaaaggcaugaaauau

SEQ ID NO: 1708 - RNA, 21 nt, Artificial Sequence
  Synthetic oligonucleotide
uagccaaaggcaugaaauauc

SEQ ID NO: 1709 - RNA, 21 nt, Artificial Sequence
  Synthetic oligonucleotide
agccaaaggcaugaaauaucu

SEQ ID NO: 1710 - RNA, 21 nt, Artificial Sequence
  Synthetic oligonucleotide
gccaaaggcaugaaauaucuu

SEQ ID NO: 1711 - RNA, 21 nt, Artificial Sequence
  Synthetic oligonucleotide
ccaaaggcaugaaauaucuug

SEQ ID NO: 1712 - RNA, 21 nt, Artificial Sequence
  Synthetic oligonucleotide
caaaggcaugaaauaucuugc

SEQ ID NO: 1713 - RNA, 21 nt, Artificial Sequence
  Synthetic oligonucleotide
caagcaaaaaguuuguccaca

SEQ ID NO: 1714 - RNA, 21 nt, Artificial Sequence
  Synthetic oligonucleotide
aagcaaaaaguuuguccacag

SEQ ID NO: 1715 - RNA, 21 nt, Artificial Sequence
  Synthetic oligonucleotide
agcaaaaaguuuguccacaga

SEQ ID NO: 1716 - RNA, 21 nt, Artificial Sequence
  Synthetic oligonucleotide
gcaaaaaguuuguccacagag

SEQ ID NO: 1717 - RNA, 21 nt, Artificial Sequence
  Synthetic oligonucleotide
caaaaaguuuguccacagaga

SEQ ID NO: 1718 - RNA, 21 nt, Artificial Sequence
  Synthetic oligonucleotide
aaaaaguuuguccacagagac

SEQ ID NO: 1719 - RNA, 21 nt, Artificial Sequence
  Synthetic oligonucleotide
aaaaguuuguccacagagacu

SEQ ID NO: 1720 - RNA, 21 nt, Artificial Sequence
  Synthetic oligonucleotide
aaaguuuguccacagagacuu

SEQ ID NO: 1721 - RNA, 21 nt, Artificial Sequence
  Synthetic oligonucleotide
gacuuggcugcaagaaacugu

SEQ ID NO: 1722 - RNA, 21 nt, Artificial Sequence
  Synthetic oligonucleotide
cuuggcugcaagaaacuguau

SEQ ID NO: 1723 - RNA, 21 nt, Artificial Sequence
  Synthetic oligonucleotide
uuggcugcaagaaacuguaug

SEQ ID NO: 1724 - RNA, 21 nt, Artificial Sequence
  Synthetic oligonucleotide
uggcugcaagaaacuguaugc

SEQ ID NO: 1725 - RNA, 21 nt, Artificial Sequence
  Synthetic oligonucleotide
ggcugcaagaaacuguaugcu

SEQ ID NO: 1726 - RNA, 21 nt, Artificial Sequence
  Synthetic oligonucleotide
cagucaagguugcugauuuug

SEQ ID NO: 1727 - RNA, 21 nt, Artificial Sequence
  Synthetic oligonucleotide
aagguugcugauuuuggucuu

SEQ ID NO: 1728 - RNA, 21 nt, Artificial Sequence
  Synthetic oligonucleotide
gguugcugauuuuggucuugc

SEQ ID NO: 1729 - RNA, 21 nt, Artificial Sequence
  Synthetic oligonucleotide
uuggucuugccagagacaugu

SEQ ID NO: 1730 - RNA, 21 nt, Artificial Sequence
  Synthetic oligonucleotide
uggucuugccagagacaugua

SEQ ID NO: 1731 - RNA, 21 nt, Artificial Sequence
  Synthetic oligonucleotide
aagcugccagugaaguggaug

SEQ ID NO: 1732 - RNA, 21 nt, Artificial Sequence
  Synthetic oligonucleotide
agcugccagugaaguggaugg

SEQ ID NO: 1733 - RNA, 21 nt, Artificial Sequence
  Synthetic oligonucleotide
aaguggauggcuuuggaaagu

SEQ ID NO: 1734 - RNA, 21 nt, Artificial Sequence
  Synthetic oligonucleotide
guggauggcuuuggaaagucu

SEQ ID NO: 1735 - RNA, 21 nt, Artificial Sequence
  Synthetic oligonucleotide
gcuuuggaaagucugcaaacu

SEQ ID NO: 1736 - RNA, 21 nt, Artificial Sequence
  Synthetic oligonucleotide
uccuuuggcgugcuccucugg

SEQ ID NO: 1737 - RNA, 21 nt, Artificial Sequence
  Synthetic oligonucleotide
cuuuggcgugcuccucuggga

SEQ ID NO: 1738 - RNA, 21 nt, Artificial Sequence
  Synthetic oligonucleotide
uuuggcgugcuccucugggag

SEQ ID NO: 1739 - RNA, 21 nt, Artificial Sequence
  Synthetic oligonucleotide
uuggcgugcuccucugggagc

SEQ ID NO: 1740 - RNA, 21 nt, Artificial Sequence
  Synthetic oligonucleotide
uggcgugcuccucugggagcu

SEQ ID NO: 1741 - RNA, 21 nt, Artificial Sequence
  Synthetic oligonucleotide
augugaacgcuacuuauguga

SEQ ID NO: 1742 - RNA, 21 nt, Artificial Sequence
  Synthetic oligonucleotide
ugugaacgcuacuuaugugaa

SEQ ID NO: 1743 - RNA, 21 nt, Artificial Sequence
  Synthetic oligonucleotide
cucuguugucaucagaagaua

SEQ ID NO: 1744 - RNA, 21 nt, Artificial Sequence
  Synthetic oligonucleotide
cuuugcucuugccaaaauugc

SEQ ID NO: 1745 - RNA, 21 nt, Artificial Sequence
  Synthetic oligonucleotide
guauuguuauuuaaauuacug

SEQ ID NO: 1746 - RNA, 21 nt, Artificial Sequence
  Synthetic oligonucleotide
uacuggauucuaaggaauuuc

SEQ ID NO: 1747 - RNA, 21 nt, Artificial Sequence
  Synthetic oligonucleotide
acuggauucuaaggaauuucu

SEQ ID NO: 1748 - RNA, 21 nt, Artificial Sequence
  Synthetic oligonucleotide
uggguugaauuuuuuaaaaau

SEQ ID NO: 1749 - RNA, 21 nt, Artificial Sequence
  Synthetic oligonucleotide
guaaacauucccuuuuaaaug

SEQ ID NO: 1750 - RNA, 21 nt, Artificial Sequence
  Synthetic oligonucleotide
uuuuaaauguuuguuuguuuu

SEQ ID NO: 1751 - RNA, 21 nt, Artificial Sequence
  Synthetic oligonucleotide
caggaucucacucuguugcca

SEQ ID NO: 1752 - RNA, 21 nt, Artificial Sequence
  Synthetic oligonucleotide
ggaucucacucuguugccagg

SEQ ID NO: 1753 - RNA, 21 nt, Artificial Sequence
  Synthetic oligonucleotide
cucacucuguugccagggcug

SEQ ID NO: 1754 - RNA, 21 nt, Artificial Sequence
  Synthetic oligonucleotide
cacucuguugccagggcugua

SEQ ID NO: 1755 - RNA, 21 nt, Artificial Sequence
  Synthetic oligonucleotide
cuguugccagggcuguagugc

SEQ ID NO: 1756 - RNA, 21 nt, Artificial Sequence
  Synthetic oligonucleotide
ggcuguagugcagugguguga

SEQ ID NO: 1757 - RNA, 21 nt, Artificial Sequence
  Synthetic oligonucleotide
gugcaguggugugaucauagc

SEQ ID NO: 1758 - RNA, 21 nt, Artificial Sequence
  Synthetic oligonucleotide
ccggcuaauuuuuguauuuuu

SEQ ID NO: 1759 - RNA, 21 nt, Artificial Sequence
  Synthetic oligonucleotide
ccuuauaaauuuuuguauaga

SEQ ID NO: 1760 - RNA, 21 nt, Artificial Sequence
  Synthetic oligonucleotide
guuggaagaauauuuauaggc

SEQ ID NO: 1761 - RNA, 21 nt, Artificial Sequence
  Synthetic oligonucleotide
cacacaaaacauguuuauaaa

SEQ ID NO: 1762 - RNA, 21 nt, Artificial Sequence
  Synthetic oligonucleotide
augacauuaagaaaauuugua

SEQ ID NO: 1763 - RNA, 21 nt, Artificial Sequence
  Synthetic oligonucleotide
uuguguguauuuuuuuaaaug

SEQ ID NO: 1764 - RNA, 21 nt, Artificial Sequence
  Synthetic oligonucleotide
aacucagcauguuuguaaagc

SEQ ID NO: 1765 - RNA, 21 nt, Artificial Sequence
  Synthetic oligonucleotide
uggauggauugaaaagauuag

SEQ ID NO: 1766 - RNA, 21 nt, Artificial Sequence
  Synthetic oligonucleotide
auucuguggaauuuugugcuu

SEQ ID NO: 1767 - RNA, 21 nt, Artificial Sequence
  Synthetic oligonucleotide
uucuguggaauuuugugcuug

SEQ ID NO: 1768 - RNA, 21 nt, Artificial Sequence
  Synthetic oligonucleotide
cuguggaauuuugugcuugcu

SEQ ID NO: 1769 - RNA, 21 nt, Artificial Sequence
  Synthetic oligonucleotide
uggaauuuugugcuugcuacu

SEQ ID NO: 1770 - RNA, 21 nt, Artificial Sequence
  Synthetic oligonucleotide
aauuuugugcuugcuacugua

SEQ ID NO: 1771 - RNA, 21 nt, Artificial Sequence
  Synthetic oligonucleotide
uuuugugcuugcuacuguaua

SEQ ID NO: 1772 - RNA, 21 nt, Artificial Sequence
  Synthetic oligonucleotide
uuugugcuugcuacuguauag

SEQ ID NO: 1773 - RNA, 21 nt, Artificial Sequence
  Synthetic oligonucleotide
uugugcuugcuacuguauagu

SEQ ID NO: 1774 - RNA, 21 nt, Artificial Sequence
  Synthetic oligonucleotide
ugugcuugcuacuguauagug

SEQ ID NO: 1775 - RNA, 21 nt, Artificial Sequence
  Synthetic oligonucleotide
gugcuugcuacuguauagugc

SEQ ID NO: 1776 - RNA, 21 nt, Artificial Sequence
  Synthetic oligonucleotide
gcuugcuacuguauagugcau

SEQ ID NO: 1777 - RNA, 21 nt, Artificial Sequence
  Synthetic oligonucleotide
uugcuacuguauagugcaugu

SEQ ID NO: 1778 - RNA, 21 nt, Artificial Sequence
  Synthetic oligonucleotide
ugcuacuguauagugcaugug

SEQ ID NO: 1779 - RNA, 21 nt, Artificial Sequence
  Synthetic oligonucleotide
gcuacuguauagugcaugugg

SEQ ID NO: 1780 - RNA, 21 nt, Artificial Sequence
  Synthetic oligonucleotide
uaaacauuuaaaguguuauau

SEQ ID NO: 1781 - RNA, 21 nt, Artificial Sequence
  Synthetic oligonucleotide
uaaaaauguuuauuuuuaaug

SEQ ID NO: 1782 - RNA, 21 nt, Artificial Sequence
  Synthetic oligonucleotide
aaaaauguuuauuuuuaauga

SEQ ID NO: 1783 - RNA, 21 nt, Artificial Sequence
  Synthetic oligonucleotide
aaaauguuuauuuuuaaugau

SEQ ID NO: 1784 - RNA, 21 nt, Artificial Sequence
  Synthetic oligonucleotide
gcacugugaacauuuuagaaa

SEQ ID NO: 1785 - RNA, 21 nt, Artificial Sequence
  Synthetic oligonucleotide
gcgauaaggaaauguacugau

SEQ ID NO: 1786 - RNA, 21 nt, Artificial Sequence
  Synthetic oligonucleotide
cgauaaggaaauguacugauu

SEQ ID NO: 1787 - RNA, 21 nt, Artificial Sequence
  Synthetic oligonucleotide
gauaaggaaauguacugauug

SEQ ID NO: 1788 - RNA, 21 nt, Artificial Sequence
  Synthetic oligonucleotide
auaaggaaauguacugauugc

SEQ ID NO: 1789 - RNA, 21 nt, Artificial Sequence
  Synthetic oligonucleotide
uaaggaaauguacugauugcc

SEQ ID NO: 1790 - RNA, 21 nt, Artificial Sequence
  Synthetic oligonucleotide
aaggaaauguacugauugcca

SEQ ID NO: 1791 - RNA, 21 nt, Artificial Sequence
  Synthetic oligonucleotide
aucaggacuugaagccaaggg

SEQ ID NO: 1792 - RNA, 21 nt, Artificial Sequence
  Synthetic oligonucleotide
ucaggacuugaagccaagggu

SEQ ID NO: 1793 - RNA, 21 nt, Artificial Sequence
  Synthetic oligonucleotide
caggacuugaagccaaggguu

SEQ ID NO: 1794 - RNA, 21 nt, Artificial Sequence
  Synthetic oligonucleotide
aggacuugaagccaaggguua

SEQ ID NO: 1795 - RNA, 21 nt, Artificial Sequence
  Synthetic oligonucleotide
ggacuugaagccaaggguuaa

SEQ ID NO: 1796 - RNA, 21 nt, Artificial Sequence
  Synthetic oligonucleotide
ugccguuucauaaauguaaua

SEQ ID NO: 1797 - RNA, 21 nt, Artificial Sequence
  Synthetic oligonucleotide
uuugcuauuuauaaacuuguc

SEQ ID NO: 1798 - RNA, 21 nt, Artificial Sequence
  Synthetic oligonucleotide
acuugucacugccuauaccug

SEQ ID NO: 1799 - RNA, 21 nt, Artificial Sequence
  Synthetic oligonucleotide
cuugucacugccuauaccugc

SEQ ID NO: 1800 - RNA, 21 nt, Artificial Sequence
  Synthetic oligonucleotide
uugucacugccuauaccugca

SEQ ID NO: 1801 - RNA, 27 nt, Artificial Sequence
  Synthetic oligonucleotide
ggcgcggagcgcgcgugugguccuuaa

SEQ ID NO: 1802 - RNA, 27 nt, Artificial Sequence
  Synthetic oligonucleotide
gcgcggagcgcgcgugugguccuugaa

SEQ ID NO: 1803 - RNA, 27 nt, Artificial Sequence
  Synthetic oligonucleotide
cgcggagcgcgcgugugguccuugcaa

SEQ ID NO: 1804 - RNA, 27 nt, Artificial Sequence
  Synthetic oligonucleotide
cggagcgcgcgugugguccuugcgcaa

SEQ ID NO: 1805 - RNA, 27 nt, Artificial Sequence
  Synthetic oligonucleotide
gagcgcgcgugugguccuugcgccgac

SEQ ID NO: 1806 - RNA, 27 nt, Artificial Sequence
  Synthetic oligonucleotide
agcgcgcgugugguccuugcgccgcca

SEQ ID NO: 1807 - RNA, 27 nt, Artificial Sequence
  Synthetic oligonucleotide
cgcgcgugugguccuugcgccgcugca

SEQ ID NO: 1808 - RNA, 27 nt, Artificial Sequence
  Synthetic oligonucleotide
gcgcgugugguccuugcgccgcugaac

SEQ ID NO: 1809 - RNA, 27 nt, Artificial Sequence
  Synthetic oligonucleotide
gcgugugguccuugcgccgcugacuca

SEQ ID NO: 1810 - RNA, 27 nt, Artificial Sequence
  Synthetic oligonucleotide
guccuugcgccgcugacuucuccacca

SEQ ID NO: 1811 - RNA, 27 nt, Artificial Sequence
  Synthetic oligonucleotide
uugcgccgcugacuucuccacugguca

SEQ ID NO: 1812 - RNA, 27 nt, Artificial Sequence
  Synthetic oligonucleotide
cgcugugcuugcaccuggcauccucac

SEQ ID NO: 1813 - RNA, 27 nt, Artificial Sequence
  Synthetic oligonucleotide
cugugcuugcaccuggcauccucguaa

SEQ ID NO: 1814 - RNA, 27 nt, Artificial Sequence
  Synthetic oligonucleotide
ugcaccuggcauccucgugcuccugcc

SEQ ID NO: 1815 - RNA, 27 nt, Artificial Sequence
  Synthetic oligonucleotide
uccucgugcuccuguuuaccuugguaa

SEQ ID NO: 1816 - RNA, 27 nt, Artificial Sequence
  Synthetic oligonucleotide
ucgugcuccuguuuaccuuggugcaac

SEQ ID NO: 1817 - RNA, 27 nt, Artificial Sequence
  Synthetic oligonucleotide
cgugcuccuguuuaccuuggugcagca

SEQ ID NO: 1818 - RNA, 27 nt, Artificial Sequence
  Synthetic oligonucleotide
gccacuaacuacauuuauguuuuaacc

SEQ ID NO: 1819 - RNA, 27 nt, Artificial Sequence
  Synthetic oligonucleotide
cuaacuacauuuauguuuuaaaugaaa

SEQ ID NO: 1820 - RNA, 27 nt, Artificial Sequence
  Synthetic oligonucleotide
uaacuacauuuauguuuuaaaugagac

SEQ ID NO: 1821 - RNA, 27 nt, Artificial Sequence
  Synthetic oligonucleotide
aacuacauuuauguuuuaaaugaggcc

SEQ ID NO: 1822 - RNA, 27 nt, Artificial Sequence
  Synthetic oligonucleotide
acuacauuuauguuuuaaaugaggaca

SEQ ID NO: 1823 - RNA, 27 nt, Artificial Sequence
  Synthetic oligonucleotide
cuacauuuauguuuuaaaugaggaaac

SEQ ID NO: 1824 - RNA, 27 nt, Artificial Sequence
  Synthetic oligonucleotide
gcuggaacacccagauuguuucccaca

SEQ ID NO: 1825 - RNA, 27 nt, Artificial Sequence
  Synthetic oligonucleotide
caggacugcagcagcaaagccaauucc

SEQ ID NO: 1826 - RNA, 27 nt, Artificial Sequence
  Synthetic oligonucleotide
aggacugcagcagcaaagccaauuucc

SEQ ID NO: 1827 - RNA, 27 nt, Artificial Sequence
  Synthetic oligonucleotide
ggacugcagcagcaaagccaauuuaca

SEQ ID NO: 1828 - RNA, 27 nt, Artificial Sequence
  Synthetic oligonucleotide
gacugcagcagcaaagccaauuuauac

SEQ ID NO: 1829 - RNA, 27 nt, Artificial Sequence
  Synthetic oligonucleotide
acugcagcagcaaagccaauuuaucca

SEQ ID NO: 1830 - RNA, 27 nt, Artificial Sequence
  Synthetic oligonucleotide
ccuacuaugaugaucaacucauuagac

SEQ ID NO: 1831 - RNA, 27 nt, Artificial Sequence
  Synthetic oligonucleotide
cuacuaugaugaucaacucauuagcca

SEQ ID NO: 1832 - RNA, 27 nt, Artificial Sequence
  Synthetic oligonucleotide
uacuaugaugaucaacucauuagcuac

SEQ ID NO: 1833 - RNA, 27 nt, Artificial Sequence
  Synthetic oligonucleotide
acuaugaugaucaacucauuagcugca

SEQ ID NO: 1834 - RNA, 27 nt, Artificial Sequence
  Synthetic oligonucleotide
cuaugaugaucaacucauuagcuguaa

SEQ ID NO: 1835 - RNA, 27 nt, Artificial Sequence
  Synthetic oligonucleotide
uaugaugaucaacucauuagcugugaa

SEQ ID NO: 1836 - RNA, 27 nt, Artificial Sequence
  Synthetic oligonucleotide
augaugaucaacucauuagcuguggac

SEQ ID NO: 1837 - RNA, 27 nt, Artificial Sequence
  Synthetic oligonucleotide
ugaugaucaacucauuagcuguggcca

SEQ ID NO: 1838 - RNA, 27 nt, Artificial Sequence
  Synthetic oligonucleotide
gaugaucaacucauuagcuguggcaaa

SEQ ID NO: 1839 - RNA, 27 nt, Artificial Sequence
  Synthetic oligonucleotide
augaucaacucauuagcuguggcagaa

SEQ ID NO: 1840 - RNA, 27 nt, Artificial Sequence
  Synthetic oligonucleotide
ugaucaacucauuagcuguggcagcac

SEQ ID NO: 1841 - RNA, 27 nt, Artificial Sequence
  Synthetic oligonucleotide
gaucaacucauuagcuguggcagcgca

SEQ ID NO: 1842 - RNA, 27 nt, Artificial Sequence
  Synthetic oligonucleotide
aucaacucauuagcuguggcagcguac

SEQ ID NO: 1843 - RNA, 27 nt, Artificial Sequence
  Synthetic oligonucleotide
ucaacucauuagcuguggcagcguccc

SEQ ID NO: 1844 - RNA, 27 nt, Artificial Sequence
  Synthetic oligonucleotide
aagaugguuuuauguuuuugacggaaa

SEQ ID NO: 1845 - RNA, 27 nt, Artificial Sequence
  Synthetic oligonucleotide
gccuuugaaagcaacaauuuuauuuca

SEQ ID NO: 1846 - RNA, 27 nt, Artificial Sequence
  Synthetic oligonucleotide
agggaaacucuagaugcucagacuucc

SEQ ID NO: 1847 - RNA, 27 nt, Artificial Sequence
  Synthetic oligonucleotide
gggaaacucuagaugcucagacuuuca

SEQ ID NO: 1848 - RNA, 27 nt, Artificial Sequence
  Synthetic oligonucleotide
ggaaacucuagaugcucagacuuuuac

SEQ ID NO: 1849 - RNA, 27 nt, Artificial Sequence
  Synthetic oligonucleotide
gaaacucuagaugcucagacuuuucca

SEQ ID NO: 1850 - RNA, 27 nt, Artificial Sequence
  Synthetic oligonucleotide
aaacucuagaugcucagacuuuucaac

SEQ ID NO: 1851 - RNA, 27 nt, Artificial Sequence
  Synthetic oligonucleotide
aacucuagaugcucagacuuuucacca

SEQ ID NO: 1852 - RNA, 27 nt, Artificial Sequence
  Synthetic oligonucleotide
cacacaagaauaaucagguucuguuaa

SEQ ID NO: 1853 - RNA, 27 nt, Artificial Sequence
  Synthetic oligonucleotide
cacaagaauaaucagguucuguucccc

SEQ ID NO: 1854 - RNA, 27 nt, Artificial Sequence
  Synthetic oligonucleotide
acaagaauaaucagguucuguuccacc

SEQ ID NO: 1855 - RNA, 27 nt, Artificial Sequence
  Synthetic oligonucleotide
caagaauaaucagguucuguuccaucc

SEQ ID NO: 1856 - RNA, 27 nt, Artificial Sequence
  Synthetic oligonucleotide
aagaauaaucagguucuguuccauacc

SEQ ID NO: 1857 - RNA, 27 nt, Artificial Sequence
  Synthetic oligonucleotide
agaauaaucagguucuguuccauaaca

SEQ ID NO: 1858 - RNA, 27 nt, Artificial Sequence
  Synthetic oligonucleotide
cuguuccauaaacucuggauugcauca

SEQ ID NO: 1859 - RNA, 27 nt, Artificial Sequence
  Synthetic oligonucleotide
cuggaguguauucucacagaaaagaac

SEQ ID NO: 1860 - RNA, 27 nt, Artificial Sequence
  Synthetic oligonucleotide
aaggaaguguuuaauauacuucaggac

SEQ ID NO: 1861 - RNA, 27 nt, Artificial Sequence
  Synthetic oligonucleotide
uucaggcugcguaugucagcaagccca

SEQ ID NO: 1862 - RNA, 27 nt, Artificial Sequence
  Synthetic oligonucleotide
ucgcacaaagcaagccagauucugcaa

SEQ ID NO: 1863 - RNA, 27 nt, Artificial Sequence
  Synthetic oligonucleotide
cgcacaaagcaagccagauucugccac

SEQ ID NO: 1864 - RNA, 27 nt, Artificial Sequence
  Synthetic oligonucleotide
gcacaaagcaagccagauucugccgcc

SEQ ID NO: 1865 - RNA, 27 nt, Artificial Sequence
  Synthetic oligonucleotide
cacaaagcaagccagauucugccgaca

SEQ ID NO: 1866 - RNA, 27 nt, Artificial Sequence
  Synthetic oligonucleotide
acaaagcaagccagauucugccgaaaa

SEQ ID NO: 1867 - RNA, 27 nt, Artificial Sequence
  Synthetic oligonucleotide
augugagaugucuccagcauuuuuaaa

SEQ ID NO: 1868 - RNA, 27 nt, Artificial Sequence
  Synthetic oligonucleotide
ugugagaugucuccagcauuuuuacaa

SEQ ID NO: 1869 - RNA, 27 nt, Artificial Sequence
  Synthetic oligonucleotide
gugagaugucuccagcauuuuuacgac

SEQ ID NO: 1870 - RNA, 27 nt, Artificial Sequence
  Synthetic oligonucleotide
ugagaugucuccagcauuuuuacggca

SEQ ID NO: 1871 - RNA, 27 nt, Artificial Sequence
  Synthetic oligonucleotide
gagaugucuccagcauuuuuacggaaa

SEQ ID NO: 1872 - RNA, 27 nt, Artificial Sequence
  Synthetic oligonucleotide
agaugucuccagcauuuuuacggacaa

SEQ ID NO: 1873 - RNA, 27 nt, Artificial Sequence
  Synthetic oligonucleotide
gaugucuccagcauuuuuacggaccac

SEQ ID NO: 1874 - RNA, 27 nt, Artificial Sequence
  Synthetic oligonucleotide
augucuccagcauuuuuacggaccccc

SEQ ID NO: 1875 - RNA, 27 nt, Artificial Sequence
  Synthetic oligonucleotide
ugucuccagcauuuuuacggacccacc

SEQ ID NO: 1876 - RNA, 27 nt, Artificial Sequence
  Synthetic oligonucleotide
gucuccagcauuuuuacggacccaaca

SEQ ID NO: 1877 - RNA, 27 nt, Artificial Sequence
  Synthetic oligonucleotide
ucuccagcauuuuuacggacccaauac

SEQ ID NO: 1878 - RNA, 27 nt, Artificial Sequence
  Synthetic oligonucleotide
cuccagcauuuuuacggacccaauccc

SEQ ID NO: 1879 - RNA, 27 nt, Artificial Sequence
  Synthetic oligonucleotide
uccagcauuuuuacggacccaaucaca

SEQ ID NO: 1880 - RNA, 27 nt, Artificial Sequence
  Synthetic oligonucleotide
ccagcauuuuuacggacccaaucauac

SEQ ID NO: 1881 - RNA, 27 nt, Artificial Sequence
  Synthetic oligonucleotide
aguuuaccacagcuuugcagcgcguca

SEQ ID NO: 1882 - RNA, 27 nt, Artificial Sequence
  Synthetic oligonucleotide
uuuaccacagcuuugcagcgcguugca

SEQ ID NO: 1883 - RNA, 27 nt, Artificial Sequence
  Synthetic oligonucleotide
uaccacagcuuugcagcgcguugaccc

SEQ ID NO: 1884 - RNA, 27 nt, Artificial Sequence
  Synthetic oligonucleotide
accacagcuuugcagcgcguugacucc

SEQ ID NO: 1885 - RNA, 27 nt, Artificial Sequence
  Synthetic oligonucleotide
cacagcuuugcagcgcguugacuuacc

SEQ ID NO: 1886 - RNA, 27 nt, Artificial Sequence
  Synthetic oligonucleotide
cagcuuugcagcgcguugacuuauuac

SEQ ID NO: 1887 - RNA, 27 nt, Artificial Sequence
  Synthetic oligonucleotide
agcuuugcagcgcguugacuuauuccc

SEQ ID NO: 1888 - RNA, 27 nt, Artificial Sequence
  Synthetic oligonucleotide
gcuuugcagcgcguugacuuauucaca

SEQ ID NO: 1889 - RNA, 27 nt, Artificial Sequence
  Synthetic oligonucleotide
cuuugcagcgcguugacuuauucauaa

SEQ ID NO: 1890 - RNA, 27 nt, Artificial Sequence
  Synthetic oligonucleotide
gcugaccauauguggcugggacuuuaa

SEQ ID NO: 1891 - RNA, 27 nt, Artificial Sequence
  Synthetic oligonucleotide
cugaccauauguggcugggacuuugac

SEQ ID NO: 1892 - RNA, 27 nt, Artificial Sequence
  Synthetic oligonucleotide
ugaccauauguggcugggacuuuggcc

SEQ ID NO: 1893 - RNA, 27 nt, Artificial Sequence
  Synthetic oligonucleotide
gaccauauguggcugggacuuuggacc

SEQ ID NO: 1894 - RNA, 27 nt, Artificial Sequence
  Synthetic oligonucleotide
accauauguggcugggacuuuggaucc

SEQ ID NO: 1895 - RNA, 27 nt, Artificial Sequence
  Synthetic oligonucleotide
ccauauguggcugggacuuuggauuca

SEQ ID NO: 1896 - RNA, 27 nt, Artificial Sequence
  Synthetic oligonucleotide
cauauguggcugggacuuuggauuuaa

SEQ ID NO: 1897 - RNA, 27 nt, Artificial Sequence
  Synthetic oligonucleotide
auauguggcugggacuuuggauuucaa

SEQ ID NO: 1898 - RNA, 27 nt, Artificial Sequence
  Synthetic oligonucleotide
uauguggcugggacuuuggauuucgac

SEQ ID NO: 1899 - RNA, 27 nt, Artificial Sequence
  Synthetic oligonucleotide
auguggcugggacuuuggauuucggca

SEQ ID NO: 1900 - RNA, 27 nt, Artificial Sequence
  Synthetic oligonucleotide
uucggaggaauaauaaauuugauuucc

SEQ ID NO: 1901 - RNA, 27 nt, Artificial Sequence
  Synthetic oligonucleotide
aggaauaauaaauuugauuuaaagacc

SEQ ID NO: 1902 - RNA, 27 nt, Artificial Sequence
  Synthetic oligonucleotide
ggaauaauaaauuugauuuaaagaacc

SEQ ID NO: 1903 - RNA, 27 nt, Artificial Sequence
  Synthetic oligonucleotide
cauugaaaugcacaguugguccugcac

SEQ ID NO: 1904 - RNA, 27 nt, Artificial Sequence
  Synthetic oligonucleotide
auugaaaugcacaguugguccugcccc

SEQ ID NO: 1905 - RNA, 27 nt, Artificial Sequence
  Synthetic oligonucleotide
uucaauauguccauaauuauuucaacc

SEQ ID NO: 1906 - RNA, 27 nt, Artificial Sequence
  Synthetic oligonucleotide
gguggaaaaacauguacuuuaaaaaac

SEQ ID NO: 1907 - RNA, 27 nt, Artificial Sequence
  Synthetic oligonucleotide
uguaccacuccuucccugcaacagcca

SEQ ID NO: 1908 - RNA, 27 nt, Artificial Sequence
  Synthetic oligonucleotide
uaagccuuuugaaaagccagugaugcc

SEQ ID NO: 1909 - RNA, 27 nt, Artificial Sequence
  Synthetic oligonucleotide
ugauauugacccugaagcaguuaaaaa

SEQ ID NO: 1910 - RNA, 27 nt, Artificial Sequence
  Synthetic oligonucleotide
gauauugacccugaagcaguuaaagac

SEQ ID NO: 1911 - RNA, 27 nt, Artificial Sequence
  Synthetic oligonucleotide
auauugacccugaagcaguuaaaggca

SEQ ID NO: 1912 - RNA, 27 nt, Artificial Sequence
  Synthetic oligonucleotide
uauugacccugaagcaguuaaagguac

SEQ ID NO: 1913 - RNA, 27 nt, Artificial Sequence
  Synthetic oligonucleotide
auugacccugaagcaguuaaaggugcc

SEQ ID NO: 1914 - RNA, 27 nt, Artificial Sequence
  Synthetic oligonucleotide
uugacccugaagcaguuaaaggugaca

SEQ ID NO: 1915 - RNA, 27 nt, Artificial Sequence
  Synthetic oligonucleotide
ugacccugaagcaguuaaaggugaaac

SEQ ID NO: 1916 - RNA, 27 nt, Artificial Sequence
  Synthetic oligonucleotide
gacccugaagcaguuaaaggugaagca

SEQ ID NO: 1917 - RNA, 27 nt, Artificial Sequence
  Synthetic oligonucleotide
acccugaagcaguuaaaggugaaguac

SEQ ID NO: 1918 - RNA, 27 nt, Artificial Sequence
  Synthetic oligonucleotide
cccugaagcaguuaaaggugaagugcc

SEQ ID NO: 1919 - RNA, 27 nt, Artificial Sequence
  Synthetic oligonucleotide
ccugaagcaguuaaaggugaagugucc

SEQ ID NO: 1920 - RNA, 27 nt, Artificial Sequence
  Synthetic oligonucleotide
cugaagcaguuaaaggugaaguguucc

SEQ ID NO: 1921 - RNA, 27 nt, Artificial Sequence
  Synthetic oligonucleotide
ugaagcaguuaaaggugaaguguuacc

SEQ ID NO: 1922 - RNA, 27 nt, Artificial Sequence
  Synthetic oligonucleotide
gaagcaguuaaaggugaaguguuaacc

SEQ ID NO: 1923 - RNA, 27 nt, Artificial Sequence
  Synthetic oligonucleotide
aagcaguuaaaggugaaguguuaaaca

SEQ ID NO: 1924 - RNA, 27 nt, Artificial Sequence
  Synthetic oligonucleotide
agcaguuaaaggugaaguguuaaaaac

SEQ ID NO: 1925 - RNA, 27 nt, Artificial Sequence
  Synthetic oligonucleotide
gcaguuaaaggugaaguguuaaaagcc

SEQ ID NO: 1926 - RNA, 27 nt, Artificial Sequence
  Synthetic oligonucleotide
caguuaaaggugaaguguuaaaaguca

SEQ ID NO: 1927 - RNA, 27 nt, Artificial Sequence
  Synthetic oligonucleotide
aguuaaaggugaaguguuaaaaguuaa

SEQ ID NO: 1928 - RNA, 27 nt, Artificial Sequence
  Synthetic oligonucleotide
guuaaaggugaaguguuaaaaguugac

SEQ ID NO: 1929 - RNA, 27 nt, Artificial Sequence
  Synthetic oligonucleotide
uuaaaggugaaguguuaaaaguuggcc

SEQ ID NO: 1930 - RNA, 27 nt, Artificial Sequence
  Synthetic oligonucleotide
uaaaggugaaguguuaaaaguuggacc

SEQ ID NO: 1931 - RNA, 27 nt, Artificial Sequence
  Synthetic oligonucleotide
aaaggugaaguguuaaaaguuggaacc

SEQ ID NO: 1932 - RNA, 27 nt, Artificial Sequence
  Synthetic oligonucleotide
aaggugaaguguuaaaaguuggaaacc

SEQ ID NO: 1933 - RNA, 27 nt, Artificial Sequence
  Synthetic oligonucleotide
aggugaaguguuaaaaguuggaaaucc

SEQ ID NO: 1934 - RNA, 27 nt, Artificial Sequence
  Synthetic oligonucleotide
ggugaaguguuaaaaguuggaaauaca

SEQ ID NO: 1935 - RNA, 27 nt, Artificial Sequence
  Synthetic oligonucleotide
gugaaguguuaaaaguuggaaauaaac

SEQ ID NO: 1936 - RNA, 27 nt, Artificial Sequence
  Synthetic oligonucleotide
ugaaguguuaaaaguuggaaauaagca

SEQ ID NO: 1937 - RNA, 27 nt, Artificial Sequence
  Synthetic oligonucleotide
gaaguguuaaaaguuggaaauaagaaa

SEQ ID NO: 1938 - RNA, 27 nt, Artificial Sequence
  Synthetic oligonucleotide
auugaacagcgagcuaaauauagagca

SEQ ID NO: 1939 - RNA, 27 nt, Artificial Sequence
  Synthetic oligonucleotide
uugaacagcgagcuaaauauagaguaa

SEQ ID NO: 1940 - RNA, 27 nt, Artificial Sequence
  Synthetic oligonucleotide
ugaacagcgagcuaaauauagagugac

SEQ ID NO: 1941 - RNA, 27 nt, Artificial Sequence
  Synthetic oligonucleotide
gaacagcgagcuaaauauagaguggcc

SEQ ID NO: 1942 - RNA, 27 nt, Artificial Sequence
  Synthetic oligonucleotide
aacagcgagcuaaauauagaguggaca

SEQ ID NO: 1943 - RNA, 27 nt, Artificial Sequence
  Synthetic oligonucleotide
acagcgagcuaaauauagaguggaaaa

SEQ ID NO: 1944 - RNA, 27 nt, Artificial Sequence
  Synthetic oligonucleotide
cagcgagcuaaauauagaguggaagac

SEQ ID NO: 1945 - RNA, 27 nt, Artificial Sequence
  Synthetic oligonucleotide
agcgagcuaaauauagaguggaagccc

SEQ ID NO: 1946 - RNA, 27 nt, Artificial Sequence
  Synthetic oligonucleotide
gcgagcuaaauauagaguggaagcaca

SEQ ID NO: 1947 - RNA, 27 nt, Artificial Sequence
  Synthetic oligonucleotide
cgagcuaaauauagaguggaagcaaaa

SEQ ID NO: 1948 - RNA, 27 nt, Artificial Sequence
  Synthetic oligonucleotide
gagcuaaauauagaguggaagcaagac

SEQ ID NO: 1949 - RNA, 27 nt, Artificial Sequence
  Synthetic oligonucleotide
agcuaaauauagaguggaagcaagccc

SEQ ID NO: 1950 - RNA, 27 nt, Artificial Sequence
  Synthetic oligonucleotide
gcuaaauauagaguggaagcaagcacc

SEQ ID NO: 1951 - RNA, 27 nt, Artificial Sequence
  Synthetic oligonucleotide
cuaaauauagaguggaagcaagcaacc

SEQ ID NO: 1952 - RNA, 27 nt, Artificial Sequence
  Synthetic oligonucleotide
uaaauauagaguggaagcaagcaaucc

SEQ ID NO: 1953 - RNA, 27 nt, Artificial Sequence
  Synthetic oligonucleotide
aaauauagaguggaagcaagcaauuca

SEQ ID NO: 1954 - RNA, 27 nt, Artificial Sequence
  Synthetic oligonucleotide
aauauagaguggaagcaagcaauuuac

SEQ ID NO: 1955 - RNA, 27 nt, Artificial Sequence
  Synthetic oligonucleotide
cuuggguuuuuccuguggcugaaaaca

SEQ ID NO: 1956 - RNA, 27 nt, Artificial Sequence
  Synthetic oligonucleotide
guggcugaaaaagagaaagcaaauucc

SEQ ID NO: 1957 - RNA, 27 nt, Artificial Sequence
  Synthetic oligonucleotide
auuaaagaucugggcagugaauuagcc

SEQ ID NO: 1958 - RNA, 27 nt, Artificial Sequence
  Synthetic oligonucleotide
uuaaagaucugggcagugaauuaguca

SEQ ID NO: 1959 - RNA, 27 nt, Artificial Sequence
  Synthetic oligonucleotide
uaaagaucugggcagugaauuaguuaa

SEQ ID NO: 1960 - RNA, 27 nt, Artificial Sequence
  Synthetic oligonucleotide
aaagaucugggcagugaauuaguucaa

SEQ ID NO: 1961 - RNA, 27 nt, Artificial Sequence
  Synthetic oligonucleotide
aagaucugggcagugaauuaguucgac

SEQ ID NO: 1962 - RNA, 27 nt, Artificial Sequence
  Synthetic oligonucleotide
agaucugggcagugaauuaguucgccc

SEQ ID NO: 1963 - RNA, 27 nt, Artificial Sequence
  Synthetic oligonucleotide
gaucugggcagugaauuaguucgcuca

SEQ ID NO: 1964 - RNA, 27 nt, Artificial Sequence
  Synthetic oligonucleotide
aucugggcagugaauuaguucgcuaaa

SEQ ID NO: 1965 - RNA, 27 nt, Artificial Sequence
  Synthetic oligonucleotide
ucugggcagugaauuaguucgcuacac

SEQ ID NO: 1966 - RNA, 27 nt, Artificial Sequence
  Synthetic oligonucleotide
cugggcagugaauuaguucgcuacgcc

SEQ ID NO: 1967 - RNA, 27 nt, Artificial Sequence
  Synthetic oligonucleotide
ugggcagugaauuaguucgcuacgaca

SEQ ID NO: 1968 - RNA, 27 nt, Artificial Sequence
  Synthetic oligonucleotide
gggcagugaauuaguucgcuacgauaa

SEQ ID NO: 1969 - RNA, 27 nt, Artificial Sequence
  Synthetic oligonucleotide
cacacuccucauuuggauaggcuugcc

SEQ ID NO: 1970 - RNA, 27 nt, Artificial Sequence
  Synthetic oligonucleotide
acacuccucauuuggauaggcuugucc

SEQ ID NO: 1971 - RNA, 27 nt, Artificial Sequence
  Synthetic oligonucleotide
cacuccucauuuggauaggcuuguaca

SEQ ID NO: 1972 - RNA, 27 nt, Artificial Sequence
  Synthetic oligonucleotide
acuccucauuuggauaggcuuguaaac

SEQ ID NO: 1973 - RNA, 27 nt, Artificial Sequence
  Synthetic oligonucleotide
cuccucauuuggauaggcuuguaagca

SEQ ID NO: 1974 - RNA, 27 nt, Artificial Sequence
  Synthetic oligonucleotide
uccucauuuggauaggcuuguaaguaa

SEQ ID NO: 1975 - RNA, 27 nt, Artificial Sequence
  Synthetic oligonucleotide
ccucauuuggauaggcuuguaagugaa

SEQ ID NO: 1976 - RNA, 27 nt, Artificial Sequence
  Synthetic oligonucleotide
cucauuuggauaggcuuguaagugcaa

SEQ ID NO: 1977 - RNA, 27 nt, Artificial Sequence
  Synthetic oligonucleotide
ucauuuggauaggcuuguaagugccaa

SEQ ID NO: 1978 - RNA, 27 nt, Artificial Sequence
  Synthetic oligonucleotide
cauuuggauaggcuuguaagugcccac

SEQ ID NO: 1979 - RNA, 27 nt, Artificial Sequence
  Synthetic oligonucleotide
auuuggauaggcuuguaagugcccgcc

SEQ ID NO: 1980 - RNA, 27 nt, Artificial Sequence
  Synthetic oligonucleotide
uuuggauaggcuuguaagugcccgaca

SEQ ID NO: 1981 - RNA, 27 nt, Artificial Sequence
  Synthetic oligonucleotide
uuggauaggcuuguaagugcccgaaac

SEQ ID NO: 1982 - RNA, 27 nt, Artificial Sequence
  Synthetic oligonucleotide
uggauaggcuuguaagugcccgaagca

SEQ ID NO: 1983 - RNA, 27 nt, Artificial Sequence
  Synthetic oligonucleotide
ggauaggcuuguaagugcccgaaguac

SEQ ID NO: 1984 - RNA, 27 nt, Artificial Sequence
  Synthetic oligonucleotide
gauaggcuuguaagugcccgaagugcc

SEQ ID NO: 1985 - RNA, 27 nt, Artificial Sequence
  Synthetic oligonucleotide
auaggcuuguaagugcccgaagugucc

SEQ ID NO: 1986 - RNA, 27 nt, Artificial Sequence
  Synthetic oligonucleotide
uaggcuuguaagugcccgaaguguaca

SEQ ID NO: 1987 - RNA, 27 nt, Artificial Sequence
  Synthetic oligonucleotide
aggcuuguaagugcccgaaguguaaaa

SEQ ID NO: 1988 - RNA, 27 nt, Artificial Sequence
  Synthetic oligonucleotide
ggcuuguaagugcccgaaguguaagaa

SEQ ID NO: 1989 - RNA, 27 nt, Artificial Sequence
  Synthetic oligonucleotide
gcuuguaagugcccgaaguguaagcaa

SEQ ID NO: 1990 - RNA, 27 nt, Artificial Sequence
  Synthetic oligonucleotide
cuuguaagugcccgaaguguaagccac

SEQ ID NO: 1991 - RNA, 27 nt, Artificial Sequence
  Synthetic oligonucleotide
uuguaagugcccgaaguguaagccccc

SEQ ID NO: 1992 - RNA, 27 nt, Artificial Sequence
  Synthetic oligonucleotide
uguaagugcccgaaguguaagcccaca

SEQ ID NO: 1993 - RNA, 27 nt, Artificial Sequence
  Synthetic oligonucleotide
ccgagcuacuuuuccagaagaucagcc

SEQ ID NO: 1994 - RNA, 27 nt, Artificial Sequence
  Synthetic oligonucleotide
uccacauugaccucagugcucuaaaca

SEQ ID NO: 1995 - RNA, 27 nt, Artificial Sequence
  Synthetic oligonucleotide
ccacauugaccucagugcucuaaauaa

SEQ ID NO: 1996 - RNA, 27 nt, Artificial Sequence
  Synthetic oligonucleotide
cacauugaccucagugcucuaaaucac

SEQ ID NO: 1997 - RNA, 27 nt, Artificial Sequence
  Synthetic oligonucleotide
acauugaccucagugcucuaaauccca

SEQ ID NO: 1998 - RNA, 27 nt, Artificial Sequence
  Synthetic oligonucleotide
cauugaccucagugcucuaaauccaac

SEQ ID NO: 1999 - RNA, 27 nt, Artificial Sequence
  Synthetic oligonucleotide
auugaccucagugcucuaaauccagca

SEQ ID NO: 2000 - RNA, 27 nt, Artificial Sequence
  Synthetic oligonucleotide
uugaccucagugcucuaaauccagaaa

SEQ ID NO: 2001 - RNA, 27 nt, Artificial Sequence
  Synthetic oligonucleotide
ugaccucagugcucuaaauccagagac

SEQ ID NO: 2002 - RNA, 27 nt, Artificial Sequence
  Synthetic oligonucleotide
gaccucagugcucuaaauccagagcca

SEQ ID NO: 2003 - RNA, 27 nt, Artificial Sequence
  Synthetic oligonucleotide
accucagugcucuaaauccagagcuaa

SEQ ID NO: 2004 - RNA, 27 nt, Artificial Sequence
  Synthetic oligonucleotide
ccucagugcucuaaauccagagcugac

SEQ ID NO: 2005 - RNA, 27 nt, Artificial Sequence
  Synthetic oligonucleotide
cucagugcucuaaauccagagcuggca

SEQ ID NO: 2006 - RNA, 27 nt, Artificial Sequence
  Synthetic oligonucleotide
ucagugcucuaaauccagagcugguaa

SEQ ID NO: 2007 - RNA, 27 nt, Artificial Sequence
  Synthetic oligonucleotide
cagugcucuaaauccagagcuggucac

SEQ ID NO: 2008 - RNA, 27 nt, Artificial Sequence
  Synthetic oligonucleotide
agugcucuaaauccagagcugguccca

SEQ ID NO: 2009 - RNA, 27 nt, Artificial Sequence
  Synthetic oligonucleotide
gugcucuaaauccagagcugguccaaa

SEQ ID NO: 2010 - RNA, 27 nt, Artificial Sequence
  Synthetic oligonucleotide
ugcucuaaauccagagcugguccagaa

SEQ ID NO: 2011 - RNA, 27 nt, Artificial Sequence
  Synthetic oligonucleotide
gcucuaaauccagagcugguccaggac

SEQ ID NO: 2012 - RNA, 27 nt, Artificial Sequence
  Synthetic oligonucleotide
cucuaaauccagagcugguccaggcca

SEQ ID NO: 2013 - RNA, 27 nt, Artificial Sequence
  Synthetic oligonucleotide
ucuaaauccagagcugguccaggcaac

SEQ ID NO: 2014 - RNA, 27 nt, Artificial Sequence
  Synthetic oligonucleotide
guagccugauugugcauuucaaugaca

SEQ ID NO: 2015 - RNA, 27 nt, Artificial Sequence
  Synthetic oligonucleotide
uagccugauugugcauuucaaugaaac

SEQ ID NO: 2016 - RNA, 27 nt, Artificial Sequence
  Synthetic oligonucleotide
agccugauugugcauuucaaugaagca

SEQ ID NO: 2017 - RNA, 27 nt, Artificial Sequence
  Synthetic oligonucleotide
gccugauugugcauuucaaugaaguac

SEQ ID NO: 2018 - RNA, 27 nt, Artificial Sequence
  Synthetic oligonucleotide
ccugauugugcauuucaaugaaguccc

SEQ ID NO: 2019 - RNA, 27 nt, Artificial Sequence
  Synthetic oligonucleotide
cugauugugcauuucaaugaagucacc

SEQ ID NO: 2020 - RNA, 27 nt, Artificial Sequence
  Synthetic oligonucleotide
ugauugugcauuucaaugaagucauca

SEQ ID NO: 2021 - RNA, 27 nt, Artificial Sequence
  Synthetic oligonucleotide
gauugugcauuucaaugaagucauaaa

SEQ ID NO: 2022 - RNA, 27 nt, Artificial Sequence
  Synthetic oligonucleotide
auugugcauuucaaugaagucauagac

SEQ ID NO: 2023 - RNA, 27 nt, Artificial Sequence
  Synthetic oligonucleotide
uugugcauuucaaugaagucauaggcc

SEQ ID NO: 2024 - RNA, 27 nt, Artificial Sequence
  Synthetic oligonucleotide
ugugcauuucaaugaagucauaggaca

SEQ ID NO: 2025 - RNA, 27 nt, Artificial Sequence
  Synthetic oligonucleotide
gugcauuucaaugaagucauaggaaac

SEQ ID NO: 2026 - RNA, 27 nt, Artificial Sequence
  Synthetic oligonucleotide
ugcauuucaaugaagucauaggaagca

SEQ ID NO: 2027 - RNA, 27 nt, Artificial Sequence
  Synthetic oligonucleotide
gcauuucaaugaagucauaggaagaaa

SEQ ID NO: 2028 - RNA, 27 nt, Artificial Sequence
  Synthetic oligonucleotide
cauuucaaugaagucauaggaagagaa

SEQ ID NO: 2029 - RNA, 27 nt, Artificial Sequence
  Synthetic oligonucleotide
auuucaaugaagucauaggaagaggaa

SEQ ID NO: 2030 - RNA, 27 nt, Artificial Sequence
  Synthetic oligonucleotide
uuucaaugaagucauaggaagagggac

SEQ ID NO: 2031 - RNA, 27 nt, Artificial Sequence
  Synthetic oligonucleotide
uucaaugaagucauaggaagagggccc

SEQ ID NO: 2032 - RNA, 27 nt, Artificial Sequence
  Synthetic oligonucleotide
ucaaugaagucauaggaagagggcacc

SEQ ID NO: 2033 - RNA, 27 nt, Artificial Sequence
  Synthetic oligonucleotide
caaugaagucauaggaagagggcaucc

SEQ ID NO: 2034 - RNA, 27 nt, Artificial Sequence
  Synthetic oligonucleotide
aaugaagucauaggaagagggcauucc

SEQ ID NO: 2035 - RNA, 27 nt, Artificial Sequence
  Synthetic oligonucleotide
augaagucauaggaagagggcauuuca

SEQ ID NO: 2036 - RNA, 27 nt, Artificial Sequence
  Synthetic oligonucleotide
ugaagucauaggaagagggcauuuuaa

SEQ ID NO: 2037 - RNA, 27 nt, Artificial Sequence
  Synthetic oligonucleotide
gaagucauaggaagagggcauuuugac

SEQ ID NO: 2038 - RNA, 27 nt, Artificial Sequence
  Synthetic oligonucleotide
aagucauaggaagagggcauuuuggcc

SEQ ID NO: 2039 - RNA, 27 nt, Artificial Sequence
  Synthetic oligonucleotide
agucauaggaagagggcauuuugguca

SEQ ID NO: 2040 - RNA, 27 nt, Artificial Sequence
  Synthetic oligonucleotide
gucauaggaagagggcauuuugguuac

SEQ ID NO: 2041 - RNA, 27 nt, Artificial Sequence
  Synthetic oligonucleotide
ucauaggaagagggcauuuugguugca

SEQ ID NO: 2042 - RNA, 27 nt, Artificial Sequence
  Synthetic oligonucleotide
gcaagaaaauucacugugcugugaacc

SEQ ID NO: 2043 - RNA, 27 nt, Artificial Sequence
  Synthetic oligonucleotide
caagaaaauucacugugcugugaaaca

SEQ ID NO: 2044 - RNA, 27 nt, Artificial Sequence
  Synthetic oligonucleotide
aagaaaauucacugugcugugaaauaa

SEQ ID NO: 2045 - RNA, 27 nt, Artificial Sequence
  Synthetic oligonucleotide
agaaaauucacugugcugugaaaucac

SEQ ID NO: 2046 - RNA, 27 nt, Artificial Sequence
  Synthetic oligonucleotide
gaaaauucacugugcugugaaaucccc

SEQ ID NO: 2047 - RNA, 27 nt, Artificial Sequence
  Synthetic oligonucleotide
aaaauucacugugcugugaaauccuca

SEQ ID NO: 2048 - RNA, 27 nt, Artificial Sequence
  Synthetic oligonucleotide
aaauucacugugcugugaaauccuuac

SEQ ID NO: 2049 - RNA, 27 nt, Artificial Sequence
  Synthetic oligonucleotide
aauucacugugcugugaaauccuugcc

SEQ ID NO: 2050 - RNA, 27 nt, Artificial Sequence
  Synthetic oligonucleotide
auucacugugcugugaaauccuugaca

SEQ ID NO: 2051 - RNA, 27 nt, Artificial Sequence
  Synthetic oligonucleotide
uucacugugcugugaaauccuugaaac

SEQ ID NO: 2052 - RNA, 27 nt, Artificial Sequence
  Synthetic oligonucleotide
ucacugugcugugaaauccuugaacca

SEQ ID NO: 2053 - RNA, 27 nt, Artificial Sequence
  Synthetic oligonucleotide
ccgagggaaucaucaugaaagauuucc

SEQ ID NO: 2054 - RNA, 27 nt, Artificial Sequence
  Synthetic oligonucleotide
cgagggaaucaucaugaaagauuuuca

SEQ ID NO: 2055 - RNA, 27 nt, Artificial Sequence
  Synthetic oligonucleotide
augagacucauaauccaacuguaaaca

SEQ ID NO: 2056 - RNA, 27 nt, Artificial Sequence
  Synthetic oligonucleotide
ugagacucauaauccaacuguaaaaac

SEQ ID NO: 2057 - RNA, 27 nt, Artificial Sequence
  Synthetic oligonucleotide
aacuguaaaagaucuuauuggcuuuaa

SEQ ID NO: 2058 - RNA, 27 nt, Artificial Sequence
  Synthetic oligonucleotide
uuggcuuuggucuucaaguagccaaca

SEQ ID NO: 2059 - RNA, 27 nt, Artificial Sequence
  Synthetic oligonucleotide
gucuucaaguagccaaaggcaugaacc

SEQ ID NO: 2060 - RNA, 27 nt, Artificial Sequence
  Synthetic oligonucleotide
ucuucaaguagccaaaggcaugaaacc

SEQ ID NO: 2061 - RNA, 27 nt, Artificial Sequence
  Synthetic oligonucleotide
cuucaaguagccaaaggcaugaaaucc

SEQ ID NO: 2062 - RNA, 27 nt, Artificial Sequence
  Synthetic oligonucleotide
uucaaguagccaaaggcaugaaauaca

SEQ ID NO: 2063 - RNA, 27 nt, Artificial Sequence
  Synthetic oligonucleotide
ucaaguagccaaaggcaugaaauauac

SEQ ID NO: 2064 - RNA, 27 nt, Artificial Sequence
  Synthetic oligonucleotide
caaguagccaaaggcaugaaauauccc

SEQ ID NO: 2065 - RNA, 27 nt, Artificial Sequence
  Synthetic oligonucleotide
aaguagccaaaggcaugaaauaucuca

SEQ ID NO: 2066 - RNA, 27 nt, Artificial Sequence
  Synthetic oligonucleotide
aguagccaaaggcaugaaauaucuuaa

SEQ ID NO: 2067 - RNA, 27 nt, Artificial Sequence
  Synthetic oligonucleotide
guagccaaaggcaugaaauaucuugac

SEQ ID NO: 2068 - RNA, 27 nt, Artificial Sequence
  Synthetic oligonucleotide
uagccaaaggcaugaaauaucuugccc

SEQ ID NO: 2069 - RNA, 27 nt, Artificial Sequence
  Synthetic oligonucleotide
agccaaaggcaugaaauaucuugcaca

SEQ ID NO: 2070 - RNA, 27 nt, Artificial Sequence
  Synthetic oligonucleotide
gccaaaggcaugaaauaucuugcaaaa

SEQ ID NO: 2071 - RNA, 27 nt, Artificial Sequence
  Synthetic oligonucleotide
ccaaaggcaugaaauaucuugcaagac

SEQ ID NO: 2072 - RNA, 27 nt, Artificial Sequence
  Synthetic oligonucleotide
caaaggcaugaaauaucuugcaagccc

SEQ ID NO: 2073 - RNA, 27 nt, Artificial Sequence
  Synthetic oligonucleotide
caagcaaaaaguuuguccacagagaac

SEQ ID NO: 2074 - RNA, 27 nt, Artificial Sequence
  Synthetic oligonucleotide
aagcaaaaaguuuguccacagagaccc

SEQ ID NO: 2075 - RNA, 27 nt, Artificial Sequence
  Synthetic oligonucleotide
agcaaaaaguuuguccacagagacuca

SEQ ID NO: 2076 - RNA, 27 nt, Artificial Sequence
  Synthetic oligonucleotide
gcaaaaaguuuguccacagagacuuaa

SEQ ID NO: 2077 - RNA, 27 nt, Artificial Sequence
  Synthetic oligonucleotide
caaaaaguuuguccacagagacuugaa

SEQ ID NO: 2078 - RNA, 27 nt, Artificial Sequence
  Synthetic oligonucleotide
aaaaaguuuguccacagagacuuggac

SEQ ID NO: 2079 - RNA, 27 nt, Artificial Sequence
  Synthetic oligonucleotide
aaaaguuuguccacagagacuuggcca

SEQ ID NO: 2080 - RNA, 27 nt, Artificial Sequence
  Synthetic oligonucleotide
aaaguuuguccacagagacuuggcuaa

SEQ ID NO: 2081 - RNA, 27 nt, Artificial Sequence
  Synthetic oligonucleotide
gacuuggcugcaagaaacuguaugcca

SEQ ID NO: 2082 - RNA, 27 nt, Artificial Sequence
  Synthetic oligonucleotide
cuuggcugcaagaaacuguaugcugac

SEQ ID NO: 2083 - RNA, 27 nt, Artificial Sequence
  Synthetic oligonucleotide
uuggcugcaagaaacuguaugcuggcc

SEQ ID NO: 2084 - RNA, 27 nt, Artificial Sequence
  Synthetic oligonucleotide
uggcugcaagaaacuguaugcuggaca

SEQ ID NO: 2085 - RNA, 27 nt, Artificial Sequence
  Synthetic oligonucleotide
ggcugcaagaaacuguaugcuggauac

SEQ ID NO: 2086 - RNA, 27 nt, Artificial Sequence
  Synthetic oligonucleotide
cagucaagguugcugauuuuggucuca

SEQ ID NO: 2087 - RNA, 27 nt, Artificial Sequence
  Synthetic oligonucleotide
aagguugcugauuuuggucuugccaac

SEQ ID NO: 2088 - RNA, 27 nt, Artificial Sequence
  Synthetic oligonucleotide
gguugcugauuuuggucuugccagaac

SEQ ID NO: 2089 - RNA, 27 nt, Artificial Sequence
  Synthetic oligonucleotide
uuggucuugccagagacauguaugacc

SEQ ID NO: 2090 - RNA, 27 nt, Artificial Sequence
  Synthetic oligonucleotide
uggucuugccagagacauguaugaucc

SEQ ID NO: 2091 - RNA, 27 nt, Artificial Sequence
  Synthetic oligonucleotide
aagcugccagugaaguggauggcuuca

SEQ ID NO: 2092 - RNA, 27 nt, Artificial Sequence
  Synthetic oligonucleotide
agcugccagugaaguggauggcuuuaa

SEQ ID NO: 2093 - RNA, 27 nt, Artificial Sequence
  Synthetic oligonucleotide
aaguggauggcuuuggaaagucugccc

SEQ ID NO: 2094 - RNA, 27 nt, Artificial Sequence
  Synthetic oligonucleotide
guggauggcuuuggaaagucugcaaca

SEQ ID NO: 2095 - RNA, 27 nt, Artificial Sequence
  Synthetic oligonucleotide
gcuuuggaaagucugcaaacucaaaca

SEQ ID NO: 2096 - RNA, 27 nt, Artificial Sequence
  Synthetic oligonucleotide
uccuuuggcgugcuccucugggagcca

SEQ ID NO: 2097 - RNA, 27 nt, Artificial Sequence
  Synthetic oligonucleotide
cuuuggcgugcuccucugggagcugcc

SEQ ID NO: 2098 - RNA, 27 nt, Artificial Sequence
  Synthetic oligonucleotide
uuuggcgugcuccucugggagcugaca

SEQ ID NO: 2099 - RNA, 27 nt, Artificial Sequence
  Synthetic oligonucleotide
uuggcgugcuccucugggagcugauac

SEQ ID NO: 2100 - RNA, 27 nt, Artificial Sequence
  Synthetic oligonucleotide
uggcgugcuccucugggagcugaugca

SEQ ID NO: 2101 - RNA, 27 nt, Artificial Sequence
  Synthetic oligonucleotide
augugaacgcuacuuaugugaacgucc

SEQ ID NO: 2102 - RNA, 27 nt, Artificial Sequence
  Synthetic oligonucleotide
ugugaacgcuacuuaugugaacguacc

SEQ ID NO: 2103 - RNA, 27 nt, Artificial Sequence
  Synthetic oligonucleotide
cucuguugucaucagaagauaacgcca

SEQ ID NO: 2104 - RNA, 27 nt, Artificial Sequence
  Synthetic oligonucleotide
cuuugcucuugccaaaauugcacuacc

SEQ ID NO: 2105 - RNA, 27 nt, Artificial Sequence
  Synthetic oligonucleotide
guauuguuauuuaaauuacuggauuac

SEQ ID NO: 2106 - RNA, 27 nt, Artificial Sequence
  Synthetic oligonucleotide
uacuggauucuaaggaauuucuuauac

SEQ ID NO: 2107 - RNA, 27 nt, Artificial Sequence
  Synthetic oligonucleotide
acuggauucuaaggaauuucuuaucca

SEQ ID NO: 2108 - RNA, 27 nt, Artificial Sequence
  Synthetic oligonucleotide
uggguugaauuuuuuaaaaaucaggcc

SEQ ID NO: 2109 - RNA, 27 nt, Artificial Sequence
  Synthetic oligonucleotide
guaaacauucccuuuuaaauguuugcc

SEQ ID NO: 2110 - RNA, 27 nt, Artificial Sequence
  Synthetic oligonucleotide
uuuuaaauguuuguuuguuuuuugaac

SEQ ID NO: 2111 - RNA, 27 nt, Artificial Sequence
  Synthetic oligonucleotide
caggaucucacucuguugccagggcca

SEQ ID NO: 2112 - RNA, 27 nt, Artificial Sequence
  Synthetic oligonucleotide
ggaucucacucuguugccagggcugcc

SEQ ID NO: 2113 - RNA, 27 nt, Artificial Sequence
  Synthetic oligonucleotide
cucacucuguugccagggcuguaguaa

SEQ ID NO: 2114 - RNA, 27 nt, Artificial Sequence
  Synthetic oligonucleotide
cacucuguugccagggcuguagugcca

SEQ ID NO: 2115 - RNA, 27 nt, Artificial Sequence
  Synthetic oligonucleotide
cuguugccagggcuguagugcagugac

SEQ ID NO: 2116 - RNA, 27 nt, Artificial Sequence
  Synthetic oligonucleotide
ggcuguagugcaguggugugaucauca

SEQ ID NO: 2117 - RNA, 27 nt, Artificial Sequence
  Synthetic oligonucleotide
gugcaguggugugaucauagcucacca

SEQ ID NO: 2118 - RNA, 27 nt, Artificial Sequence
  Synthetic oligonucleotide
ccggcuaauuuuuguauuuuuuguaac

SEQ ID NO: 2119 - RNA, 27 nt, Artificial Sequence
  Synthetic oligonucleotide
ccuuauaaauuuuuguauagacauuaa

SEQ ID NO: 2120 - RNA, 27 nt, Artificial Sequence
  Synthetic oligonucleotide
guuggaagaauauuuauaggcaauaac

SEQ ID NO: 2121 - RNA, 27 nt, Artificial Sequence
  Synthetic oligonucleotide
cacacaaaacauguuuauaaaugaaac

SEQ ID NO: 2122 - RNA, 27 nt, Artificial Sequence
  Synthetic oligonucleotide
augacauuaagaaaauuuguaugaacc

SEQ ID NO: 2123 - RNA, 27 nt, Artificial Sequence
  Synthetic oligonucleotide
uuguguguauuuuuuuaaaugaaaaac

SEQ ID NO: 2124 - RNA, 27 nt, Artificial Sequence
  Synthetic oligonucleotide
aacucagcauguuuguaaagcaggacc

SEQ ID NO: 2125 - RNA, 27 nt, Artificial Sequence
  Synthetic oligonucleotide
uggauggauugaaaagauuagccucca

SEQ ID NO: 2126 - RNA, 27 nt, Artificial Sequence
  Synthetic oligonucleotide
auucuguggaauuuugugcuugcuaac

SEQ ID NO: 2127 - RNA, 27 nt, Artificial Sequence
  Synthetic oligonucleotide
uucuguggaauuuugugcuugcuacca

SEQ ID NO: 2128 - RNA, 27 nt, Artificial Sequence
  Synthetic oligonucleotide
cuguggaauuuugugcuugcuacugcc

SEQ ID NO: 2129 - RNA, 27 nt, Artificial Sequence
  Synthetic oligonucleotide
uggaauuuugugcuugcuacuguauca

SEQ ID NO: 2130 - RNA, 27 nt, Artificial Sequence
  Synthetic oligonucleotide
aauuuugugcuugcuacuguauaguaa

SEQ ID NO: 2131 - RNA, 27 nt, Artificial Sequence
  Synthetic oligonucleotide
uuuugugcuugcuacuguauagugccc

SEQ ID NO: 2132 - RNA, 27 nt, Artificial Sequence
  Synthetic oligonucleotide
uuugugcuugcuacuguauagugcaca

SEQ ID NO: 2133 - RNA, 27 nt, Artificial Sequence
  Synthetic oligonucleotide
uugugcuugcuacuguauagugcauac

SEQ ID NO: 2134 - RNA, 27 nt, Artificial Sequence
  Synthetic oligonucleotide
ugugcuugcuacuguauagugcaugca

SEQ ID NO: 2135 - RNA, 27 nt, Artificial Sequence
  Synthetic oligonucleotide
gugcuugcuacuguauagugcauguaa

SEQ ID NO: 2136 - RNA, 27 nt, Artificial Sequence
  Synthetic oligonucleotide
gcuugcuacuguauagugcauguggca

SEQ ID NO: 2137 - RNA, 27 nt, Artificial Sequence
  Synthetic oligonucleotide
uugcuacuguauagugcauguggugcc

SEQ ID NO: 2138 - RNA, 27 nt, Artificial Sequence
  Synthetic oligonucleotide
ugcuacuguauagugcaugugguguca

SEQ ID NO: 2139 - RNA, 27 nt, Artificial Sequence
  Synthetic oligonucleotide
gcuacuguauagugcaugugguguaaa

SEQ ID NO: 2140 - RNA, 27 nt, Artificial Sequence
  Synthetic oligonucleotide
uaaacauuuaaaguguuauauuuuucc

SEQ ID NO: 2141 - RNA, 27 nt, Artificial Sequence
  Synthetic oligonucleotide
uaaaaauguuuauuuuuaaugauauac

SEQ ID NO: 2142 - RNA, 27 nt, Artificial Sequence
  Synthetic oligonucleotide
aaaaauguuuauuuuuaaugauaugca

SEQ ID NO: 2143 - RNA, 27 nt, Artificial Sequence
  Synthetic oligonucleotide
aaaauguuuauuuuuaaugauaugaac

SEQ ID NO: 2144 - RNA, 27 nt, Artificial Sequence
  Synthetic oligonucleotide
gcacugugaacauuuuagaaaaggucc

SEQ ID NO: 2145 - RNA, 27 nt, Artificial Sequence
  Synthetic oligonucleotide
gcgauaaggaaauguacugauugcccc

SEQ ID NO: 2146 - RNA, 27 nt, Artificial Sequence
  Synthetic oligonucleotide
cgauaaggaaauguacugauugccacc

SEQ ID NO: 2147 - RNA, 27 nt, Artificial Sequence
  Synthetic oligonucleotide
gauaaggaaauguacugauugccaacc

SEQ ID NO: 2148 - RNA, 27 nt, Artificial Sequence
  Synthetic oligonucleotide
auaaggaaauguacugauugccaauca

SEQ ID NO: 2149 - RNA, 27 nt, Artificial Sequence
  Synthetic oligonucleotide
uaaggaaauguacugauugccaauaac

SEQ ID NO: 2150 - RNA, 27 nt, Artificial Sequence
  Synthetic oligonucleotide
aaggaaauguacugauugccaauacca

SEQ ID NO: 2151 - RNA, 27 nt, Artificial Sequence
  Synthetic oligonucleotide
aucaggacuugaagccaaggguuaaaa

SEQ ID NO: 2152 - RNA, 27 nt, Artificial Sequence
  Synthetic oligonucleotide
ucaggacuugaagccaaggguuaacaa

SEQ ID NO: 2153 - RNA, 27 nt, Artificial Sequence
  Synthetic oligonucleotide
caggacuugaagccaaggguuaaccac

SEQ ID NO: 2154 - RNA, 27 nt, Artificial Sequence
  Synthetic oligonucleotide
aggacuugaagccaaggguuaacccca

SEQ ID NO: 2155 - RNA, 27 nt, Artificial Sequence
  Synthetic oligonucleotide
ggacuugaagccaaggguuaacccaaa

SEQ ID NO: 2156 - RNA, 27 nt, Artificial Sequence
  Synthetic oligonucleotide
ugccguuucauaaauguaauaaguacc

SEQ ID NO: 2157 - RNA, 27 nt, Artificial Sequence
  Synthetic oligonucleotide
uuugcuauuuauaaacuuguccuuaac

SEQ ID NO: 2158 - RNA, 27 nt, Artificial Sequence
  Synthetic oligonucleotide
acuugucacugccuauaccugcagcca

SEQ ID NO: 2159 - RNA, 27 nt, Artificial Sequence
  Synthetic oligonucleotide
cuugucacugccuauaccugcagcuac

SEQ ID NO: 2160 - RNA, 27 nt, Artificial Sequence
  Synthetic oligonucleotide
uugucacugccuauaccugcagcugcc

SEQ ID NO: 2161 - RNA, 27 nt, Artificial Sequence
  Synthetic oligonucleotide
ggcgcggagcgcgcgugugguccuugc

SEQ ID NO: 2162 - RNA, 27 nt, Artificial Sequence
  Synthetic oligonucleotide
gcgcggagcgcgcgugugguccuugcg

SEQ ID NO: 2163 - RNA, 27 nt, Artificial Sequence
  Synthetic oligonucleotide
cgcggagcgcgcgugugguccuugcgc

SEQ ID NO: 2164 - RNA, 27 nt, Artificial Sequence
  Synthetic oligonucleotide
cggagcgcgcgugugguccuugcgccg

SEQ ID NO: 2165 - RNA, 27 nt, Artificial Sequence
  Synthetic oligonucleotide
gagcgcgcgugugguccuugcgccgcu

SEQ ID NO: 2166 - RNA, 27 nt, Artificial Sequence
  Synthetic oligonucleotide
agcgcgcgugugguccuugcgccgcug

SEQ ID NO: 2167 - RNA, 27 nt, Artificial Sequence
  Synthetic oligonucleotide
cgcgcgugugguccuugcgccgcugac

SEQ ID NO: 2168 - RNA, 27 nt, Artificial Sequence
  Synthetic oligonucleotide
gcgcgugugguccuugcgccgcugacu

SEQ ID NO: 2169 - RNA, 27 nt, Artificial Sequence
  Synthetic oligonucleotide
gcgugugguccuugcgccgcugacuuc

SEQ ID NO: 2170 - RNA, 27 nt, Artificial Sequence
  Synthetic oligonucleotide
guccuugcgccgcugacuucuccacug

SEQ ID NO: 2171 - RNA, 27 nt, Artificial Sequence
  Synthetic oligonucleotide
uugcgccgcugacuucuccacugguuc

SEQ ID NO: 2172 - RNA, 27 nt, Artificial Sequence
  Synthetic oligonucleotide
cgcugugcuugcaccuggcauccucgu

SEQ ID NO: 2173 - RNA, 27 nt, Artificial Sequence
  Synthetic oligonucleotide
cugugcuugcaccuggcauccucgugc

SEQ ID NO: 2174 - RNA, 27 nt, Artificial Sequence
  Synthetic oligonucleotide
ugcaccuggcauccucgugcuccuguu

SEQ ID NO: 2175 - RNA, 27 nt, Artificial Sequence
  Synthetic oligonucleotide
uccucgugcuccuguuuaccuuggugc

SEQ ID NO: 2176 - RNA, 27 nt, Artificial Sequence
  Synthetic oligonucleotide
ucgugcuccuguuuaccuuggugcaga

SEQ ID NO: 2177 - RNA, 27 nt, Artificial Sequence
  Synthetic oligonucleotide
cgugcuccuguuuaccuuggugcagag

SEQ ID NO: 2178 - RNA, 27 nt, Artificial Sequence
  Synthetic oligonucleotide
gccacuaacuacauuuauguuuuaaau

SEQ ID NO: 2179 - RNA, 27 nt, Artificial Sequence
  Synthetic oligonucleotide
cuaacuacauuuauguuuuaaaugagg

SEQ ID NO: 2180 - RNA, 27 nt, Artificial Sequence
  Synthetic oligonucleotide
uaacuacauuuauguuuuaaaugagga

SEQ ID NO: 2181 - RNA, 27 nt, Artificial Sequence
  Synthetic oligonucleotide
aacuacauuuauguuuuaaaugaggaa

SEQ ID NO: 2182 - RNA, 27 nt, Artificial Sequence
  Synthetic oligonucleotide
acuacauuuauguuuuaaaugaggaag

SEQ ID NO: 2183 - RNA, 27 nt, Artificial Sequence
  Synthetic oligonucleotide
cuacauuuauguuuuaaaugaggaaga

SEQ ID NO: 2184 - RNA, 27 nt, Artificial Sequence
  Synthetic oligonucleotide
gcuggaacacccagauuguuucccaug

SEQ ID NO: 2185 - RNA, 27 nt, Artificial Sequence
  Synthetic oligonucleotide
caggacugcagcagcaaagccaauuua

SEQ ID NO: 2186 - RNA, 27 nt, Artificial Sequence
  Synthetic oligonucleotide
aggacugcagcagcaaagccaauuuau

SEQ ID NO: 2187 - RNA, 27 nt, Artificial Sequence
  Synthetic oligonucleotide
ggacugcagcagcaaagccaauuuauc

SEQ ID NO: 2188 - RNA, 27 nt, Artificial Sequence
  Synthetic oligonucleotide
gacugcagcagcaaagccaauuuauca

SEQ ID NO: 2189 - RNA, 27 nt, Artificial Sequence
  Synthetic oligonucleotide
acugcagcagcaaagccaauuuaucag

SEQ ID NO: 2190 - RNA, 27 nt, Artificial Sequence
  Synthetic oligonucleotide
ccuacuaugaugaucaacucauuagcu

SEQ ID NO: 2191 - RNA, 27 nt, Artificial Sequence
  Synthetic oligonucleotide
cuacuaugaugaucaacucauuagcug

SEQ ID NO: 2192 - RNA, 27 nt, Artificial Sequence
  Synthetic oligonucleotide
uacuaugaugaucaacucauuagcugu

SEQ ID NO: 2193 - RNA, 27 nt, Artificial Sequence
  Synthetic oligonucleotide
acuaugaugaucaacucauuagcugug

SEQ ID NO: 2194 - RNA, 27 nt, Artificial Sequence
  Synthetic oligonucleotide
cuaugaugaucaacucauuagcugugg

SEQ ID NO: 2195 - RNA, 27 nt, Artificial Sequence
  Synthetic oligonucleotide
uaugaugaucaacucauuagcuguggc

SEQ ID NO: 2196 - RNA, 27 nt, Artificial Sequence
  Synthetic oligonucleotide
augaugaucaacucauuagcuguggca

SEQ ID NO: 2197 - RNA, 27 nt, Artificial Sequence
  Synthetic oligonucleotide
ugaugaucaacucauuagcuguggcag

SEQ ID NO: 2198 - RNA, 27 nt, Artificial Sequence
  Synthetic oligonucleotide
gaugaucaacucauuagcuguggcagc

SEQ ID NO: 2199 - RNA, 27 nt, Artificial Sequence
  Synthetic oligonucleotide
augaucaacucauuagcuguggcagcg

SEQ ID NO: 2200 - RNA, 27 nt, Artificial Sequence
  Synthetic oligonucleotide
ugaucaacucauuagcuguggcagcgu

SEQ ID NO: 2201 - RNA, 27 nt, Artificial Sequence
  Synthetic oligonucleotide
gaucaacucauuagcuguggcagcguc

SEQ ID NO: 2202 - RNA, 27 nt, Artificial Sequence
  Synthetic oligonucleotide
aucaacucauuagcuguggcagcguca

SEQ ID NO: 2203 - RNA, 27 nt, Artificial Sequence
  Synthetic oligonucleotide
ucaacucauuagcuguggcagcgucaa

SEQ ID NO: 2204 - RNA, 27 nt, Artificial Sequence
  Synthetic oligonucleotide
aagaugguuuuauguuuuugacggacc

SEQ ID NO: 2205 - RNA, 27 nt, Artificial Sequence
  Synthetic oligonucleotide
gccuuugaaagcaacaauuuuauuuac

SEQ ID NO: 2206 - RNA, 27 nt, Artificial Sequence
  Synthetic oligonucleotide
agggaaacucuagaugcucagacuuuu

SEQ ID NO: 2207 - RNA, 27 nt, Artificial Sequence
  Synthetic oligonucleotide
gggaaacucuagaugcucagacuuuuc

SEQ ID NO: 2208 - RNA, 27 nt, Artificial Sequence
  Synthetic oligonucleotide
ggaaacucuagaugcucagacuuuuca

SEQ ID NO: 2209 - RNA, 27 nt, Artificial Sequence
  Synthetic oligonucleotide
gaaacucuagaugcucagacuuuucac

SEQ ID NO: 2210 - RNA, 27 nt, Artificial Sequence
  Synthetic oligonucleotide
aaacucuagaugcucagacuuuucaca

SEQ ID NO: 2211 - RNA, 27 nt, Artificial Sequence
  Synthetic oligonucleotide
aacucuagaugcucagacuuuucacac

SEQ ID NO: 2212 - RNA, 27 nt, Artificial Sequence
  Synthetic oligonucleotide
cacacaagaauaaucagguucuguucc

SEQ ID NO: 2213 - RNA, 27 nt, Artificial Sequence
  Synthetic oligonucleotide
cacaagaauaaucagguucuguuccau

SEQ ID NO: 2214 - RNA, 27 nt, Artificial Sequence
  Synthetic oligonucleotide
acaagaauaaucagguucuguuccaua

SEQ ID NO: 2215 - RNA, 27 nt, Artificial Sequence
  Synthetic oligonucleotide
caagaauaaucagguucuguuccauaa

SEQ ID NO: 2216 - RNA, 27 nt, Artificial Sequence
  Synthetic oligonucleotide
aagaauaaucagguucuguuccauaaa

SEQ ID NO: 2217 - RNA, 27 nt, Artificial Sequence
  Synthetic oligonucleotide
agaauaaucagguucuguuccauaaac

SEQ ID NO: 2218 - RNA, 27 nt, Artificial Sequence
  Synthetic oligonucleotide
cuguuccauaaacucuggauugcauuc

SEQ ID NO: 2219 - RNA, 27 nt, Artificial Sequence
  Synthetic oligonucleotide
cuggaguguauucucacagaaaagaga

SEQ ID NO: 2220 - RNA, 27 nt, Artificial Sequence
  Synthetic oligonucleotide
aaggaaguguuuaauauacuucaggcu

SEQ ID NO: 2221 - RNA, 27 nt, Artificial Sequence
  Synthetic oligonucleotide
uucaggcugcguaugucagcaagccug

SEQ ID NO: 2222 - RNA, 27 nt, Artificial Sequence
  Synthetic oligonucleotide
ucgcacaaagcaagccagauucugccg

SEQ ID NO: 2223 - RNA, 27 nt, Artificial Sequence
  Synthetic oligonucleotide
cgcacaaagcaagccagauucugccga

SEQ ID NO: 2224 - RNA, 27 nt, Artificial Sequence
  Synthetic oligonucleotide
gcacaaagcaagccagauucugccgaa

SEQ ID NO: 2225 - RNA, 27 nt, Artificial Sequence
  Synthetic oligonucleotide
cacaaagcaagccagauucugccgaac

SEQ ID NO: 2226 - RNA, 27 nt, Artificial Sequence
  Synthetic oligonucleotide
acaaagcaagccagauucugccgaacc

SEQ ID NO: 2227 - RNA, 27 nt, Artificial Sequence
  Synthetic oligonucleotide
augugagaugucuccagcauuuuuacg

SEQ ID NO: 2228 - RNA, 27 nt, Artificial Sequence
  Synthetic oligonucleotide
ugugagaugucuccagcauuuuuacgg

SEQ ID NO: 2229 - RNA, 27 nt, Artificial Sequence
  Synthetic oligonucleotide
gugagaugucuccagcauuuuuacgga

SEQ ID NO: 2230 - RNA, 27 nt, Artificial Sequence
  Synthetic oligonucleotide
ugagaugucuccagcauuuuuacggac

SEQ ID NO: 2231 - RNA, 27 nt, Artificial Sequence
  Synthetic oligonucleotide
gagaugucuccagcauuuuuacggacc

SEQ ID NO: 2232 - RNA, 27 nt, Artificial Sequence
  Synthetic oligonucleotide
agaugucuccagcauuuuuacggaccc

SEQ ID NO: 2233 - RNA, 27 nt, Artificial Sequence
  Synthetic oligonucleotide
gaugucuccagcauuuuuacggaccca

SEQ ID NO: 2234 - RNA, 27 nt, Artificial Sequence
  Synthetic oligonucleotide
augucuccagcauuuuuacggacccaa

SEQ ID NO: 2235 - RNA, 27 nt, Artificial Sequence
  Synthetic oligonucleotide
ugucuccagcauuuuuacggacccaau

SEQ ID NO: 2236 - RNA, 27 nt, Artificial Sequence
  Synthetic oligonucleotide
gucuccagcauuuuuacggacccaauc

SEQ ID NO: 2237 - RNA, 27 nt, Artificial Sequence
  Synthetic oligonucleotide
ucuccagcauuuuuacggacccaauca

SEQ ID NO: 2238 - RNA, 27 nt, Artificial Sequence
  Synthetic oligonucleotide
cuccagcauuuuuacggacccaaucau

SEQ ID NO: 2239 - RNA, 27 nt, Artificial Sequence
  Synthetic oligonucleotide
uccagcauuuuuacggacccaaucaug

SEQ ID NO: 2240 - RNA, 27 nt, Artificial Sequence
  Synthetic oligonucleotide
ccagcauuuuuacggacccaaucauga

SEQ ID NO: 2241 - RNA, 27 nt, Artificial Sequence
  Synthetic oligonucleotide
aguuuaccacagcuuugcagcgcguug

SEQ ID NO: 2242 - RNA, 27 nt, Artificial Sequence
  Synthetic oligonucleotide
uuuaccacagcuuugcagcgcguugac

SEQ ID NO: 2243 - RNA, 27 nt, Artificial Sequence
  Synthetic oligonucleotide
uaccacagcuuugcagcgcguugacuu

SEQ ID NO: 2244 - RNA, 27 nt, Artificial Sequence
  Synthetic oligonucleotide
accacagcuuugcagcgcguugacuua

SEQ ID NO: 2245 - RNA, 27 nt, Artificial Sequence
  Synthetic oligonucleotide
cacagcuuugcagcgcguugacuuauu

SEQ ID NO: 2246 - RNA, 27 nt, Artificial Sequence
  Synthetic oligonucleotide
cagcuuugcagcgcguugacuuauuca

SEQ ID NO: 2247 - RNA, 27 nt, Artificial Sequence
  Synthetic oligonucleotide
agcuuugcagcgcguugacuuauucau

SEQ ID NO: 2248 - RNA, 27 nt, Artificial Sequence
  Synthetic oligonucleotide
gcuuugcagcgcguugacuuauucaug

SEQ ID NO: 2249 - RNA, 27 nt, Artificial Sequence
  Synthetic oligonucleotide
cuuugcagcgcguugacuuauucaugg

SEQ ID NO: 2250 - RNA, 27 nt, Artificial Sequence
  Synthetic oligonucleotide
gcugaccauauguggcugggacuuugg

SEQ ID NO: 2251 - RNA, 27 nt, Artificial Sequence
  Synthetic oligonucleotide
cugaccauauguggcugggacuuugga

SEQ ID NO: 2252 - RNA, 27 nt, Artificial Sequence
  Synthetic oligonucleotide
ugaccauauguggcugggacuuuggau

SEQ ID NO: 2253 - RNA, 27 nt, Artificial Sequence
  Synthetic oligonucleotide
gaccauauguggcugggacuuuggauu

SEQ ID NO: 2254 - RNA, 27 nt, Artificial Sequence
  Synthetic oligonucleotide
accauauguggcugggacuuuggauuu

SEQ ID NO: 2255 - RNA, 27 nt, Artificial Sequence
  Synthetic oligonucleotide
ccauauguggcugggacuuuggauuuc

SEQ ID NO: 2256 - RNA, 27 nt, Artificial Sequence
  Synthetic oligonucleotide
cauauguggcugggacuuuggauuucg

SEQ ID NO: 2257 - RNA, 27 nt, Artificial Sequence
  Synthetic oligonucleotide
auauguggcugggacuuuggauuucgg

SEQ ID NO: 2258 - RNA, 27 nt, Artificial Sequence
  Synthetic oligonucleotide
uauguggcugggacuuuggauuucgga

SEQ ID NO: 2259 - RNA, 27 nt, Artificial Sequence
  Synthetic oligonucleotide
auguggcugggacuuuggauuucggag

SEQ ID NO: 2260 - RNA, 27 nt, Artificial Sequence
  Synthetic oligonucleotide
uucggaggaauaauaaauuugauuuaa

SEQ ID NO: 2261 - RNA, 27 nt, Artificial Sequence
  Synthetic oligonucleotide
aggaauaauaaauuugauuuaaagaaa

SEQ ID NO: 2262 - RNA, 27 nt, Artificial Sequence
  Synthetic oligonucleotide
ggaauaauaaauuugauuuaaagaaaa

SEQ ID NO: 2263 - RNA, 27 nt, Artificial Sequence
  Synthetic oligonucleotide
cauugaaaugcacaguugguccugcca

SEQ ID NO: 2264 - RNA, 27 nt, Artificial Sequence
  Synthetic oligonucleotide
auugaaaugcacaguugguccugccau

SEQ ID NO: 2265 - RNA, 27 nt, Artificial Sequence
  Synthetic oligonucleotide
uucaauauguccauaauuauuucaaau

SEQ ID NO: 2266 - RNA, 27 nt, Artificial Sequence
  Synthetic oligonucleotide
gguggaaaaacauguacuuuaaaaagu

SEQ ID NO: 2267 - RNA, 27 nt, Artificial Sequence
  Synthetic oligonucleotide
uguaccacuccuucccugcaacagcug

SEQ ID NO: 2268 - RNA, 27 nt, Artificial Sequence
  Synthetic oligonucleotide
uaagccuuuugaaaagccagugaugau

SEQ ID NO: 2269 - RNA, 27 nt, Artificial Sequence
  Synthetic oligonucleotide
ugauauugacccugaagcaguuaaagg

SEQ ID NO: 2270 - RNA, 27 nt, Artificial Sequence
  Synthetic oligonucleotide
gauauugacccugaagcaguuaaaggu

SEQ ID NO: 2271 - RNA, 27 nt, Artificial Sequence
  Synthetic oligonucleotide
auauugacccugaagcaguuaaaggug

SEQ ID NO: 2272 - RNA, 27 nt, Artificial Sequence
  Synthetic oligonucleotide
uauugacccugaagcaguuaaagguga

SEQ ID NO: 2273 - RNA, 27 nt, Artificial Sequence
  Synthetic oligonucleotide
auugacccugaagcaguuaaaggugaa

SEQ ID NO: 2274 - RNA, 27 nt, Artificial Sequence
  Synthetic oligonucleotide
uugacccugaagcaguuaaaggugaag

SEQ ID NO: 2275 - RNA, 27 nt, Artificial Sequence
  Synthetic oligonucleotide
ugacccugaagcaguuaaaggugaagu

SEQ ID NO: 2276 - RNA, 27 nt, Artificial Sequence
  Synthetic oligonucleotide
gacccugaagcaguuaaaggugaagug

SEQ ID NO: 2277 - RNA, 27 nt, Artificial Sequence
  Synthetic oligonucleotide
acccugaagcaguuaaaggugaagugu

SEQ ID NO: 2278 - RNA, 27 nt, Artificial Sequence
  Synthetic oligonucleotide
cccugaagcaguuaaaggugaaguguu

SEQ ID NO: 2279 - RNA, 27 nt, Artificial Sequence
  Synthetic oligonucleotide
ccugaagcaguuaaaggugaaguguua

SEQ ID NO: 2280 - RNA, 27 nt, Artificial Sequence
  Synthetic oligonucleotide
cugaagcaguuaaaggugaaguguuaa

SEQ ID NO: 2281 - RNA, 27 nt, Artificial Sequence
  Synthetic oligonucleotide
ugaagcaguuaaaggugaaguguuaaa

SEQ ID NO: 2282 - RNA, 27 nt, Artificial Sequence
  Synthetic oligonucleotide
gaagcaguuaaaggugaaguguuaaaa

SEQ ID NO: 2283 - RNA, 27 nt, Artificial Sequence
  Synthetic oligonucleotide
aagcaguuaaaggugaaguguuaaaag

SEQ ID NO: 2284 - RNA, 27 nt, Artificial Sequence
  Synthetic oligonucleotide
agcaguuaaaggugaaguguuaaaagu

SEQ ID NO: 2285 - RNA, 27 nt, Artificial Sequence
  Synthetic oligonucleotide
gcaguuaaaggugaaguguuaaaaguu

SEQ ID NO: 2286 - RNA, 27 nt, Artificial Sequence
  Synthetic oligonucleotide
caguuaaaggugaaguguuaaaaguug

SEQ ID NO: 2287 - RNA, 27 nt, Artificial Sequence
  Synthetic oligonucleotide
aguuaaaggugaaguguuaaaaguugg

SEQ ID NO: 2288 - RNA, 27 nt, Artificial Sequence
  Synthetic oligonucleotide
guuaaaggugaaguguuaaaaguugga

SEQ ID NO: 2289 - RNA, 27 nt, Artificial Sequence
  Synthetic oligonucleotide
uuaaaggugaaguguuaaaaguuggaa

SEQ ID NO: 2290 - RNA, 27 nt, Artificial Sequence
  Synthetic oligonucleotide
uaaaggugaaguguuaaaaguuggaaa

SEQ ID NO: 2291 - RNA, 27 nt, Artificial Sequence
  Synthetic oligonucleotide
aaaggugaaguguuaaaaguuggaaau

SEQ ID NO: 2292 - RNA, 27 nt, Artificial Sequence
  Synthetic oligonucleotide
aaggugaaguguuaaaaguuggaaaua

SEQ ID NO: 2293 - RNA, 27 nt, Artificial Sequence
  Synthetic oligonucleotide
aggugaaguguuaaaaguuggaaauaa

SEQ ID NO: 2294 - RNA, 27 nt, Artificial Sequence
  Synthetic oligonucleotide
ggugaaguguuaaaaguuggaaauaag

SEQ ID NO: 2295 - RNA, 27 nt, Artificial Sequence
  Synthetic oligonucleotide
gugaaguguuaaaaguuggaaauaaga

SEQ ID NO: 2296 - RNA, 27 nt, Artificial Sequence
  Synthetic oligonucleotide
ugaaguguuaaaaguuggaaauaagag

SEQ ID NO: 2297 - RNA, 27 nt, Artificial Sequence
  Synthetic oligonucleotide
gaaguguuaaaaguuggaaauaagagc

SEQ ID NO: 2298 - RNA, 27 nt, Artificial Sequence
  Synthetic oligonucleotide
auugaacagcgagcuaaauauagagug

SEQ ID NO: 2299 - RNA, 27 nt, Artificial Sequence
  Synthetic oligonucleotide
uugaacagcgagcuaaauauagagugg

SEQ ID NO: 2300 - RNA, 27 nt, Artificial Sequence
  Synthetic oligonucleotide
ugaacagcgagcuaaauauagagugga

SEQ ID NO: 2301 - RNA, 27 nt, Artificial Sequence
  Synthetic oligonucleotide
gaacagcgagcuaaauauagaguggaa

SEQ ID NO: 2302 - RNA, 27 nt, Artificial Sequence
  Synthetic oligonucleotide
aacagcgagcuaaauauagaguggaag

SEQ ID NO: 2303 - RNA, 27 nt, Artificial Sequence
  Synthetic oligonucleotide
acagcgagcuaaauauagaguggaagc

SEQ ID NO: 2304 - RNA, 27 nt, Artificial Sequence
  Synthetic oligonucleotide
cagcgagcuaaauauagaguggaagca

SEQ ID NO: 2305 - RNA, 27 nt, Artificial Sequence
  Synthetic oligonucleotide
agcgagcuaaauauagaguggaagcaa

SEQ ID NO: 2306 - RNA, 27 nt, Artificial Sequence
  Synthetic oligonucleotide
gcgagcuaaauauagaguggaagcaag

SEQ ID NO: 2307 - RNA, 27 nt, Artificial Sequence
  Synthetic oligonucleotide
cgagcuaaauauagaguggaagcaagc

SEQ ID NO: 2308 - RNA, 27 nt, Artificial Sequence
  Synthetic oligonucleotide
gagcuaaauauagaguggaagcaagca

SEQ ID NO: 2309 - RNA, 27 nt, Artificial Sequence
  Synthetic oligonucleotide
agcuaaauauagaguggaagcaagcaa

SEQ ID NO: 2310 - RNA, 27 nt, Artificial Sequence
  Synthetic oligonucleotide
gcuaaauauagaguggaagcaagcaau

SEQ ID NO: 2311 - RNA, 27 nt, Artificial Sequence
  Synthetic oligonucleotide
cuaaauauagaguggaagcaagcaauu

SEQ ID NO: 2312 - RNA, 27 nt, Artificial Sequence
  Synthetic oligonucleotide
uaaauauagaguggaagcaagcaauuu

SEQ ID NO: 2313 - RNA, 27 nt, Artificial Sequence
  Synthetic oligonucleotide
aaauauagaguggaagcaagcaauuuc

SEQ ID NO: 2314 - RNA, 27 nt, Artificial Sequence
  Synthetic oligonucleotide
aauauagaguggaagcaagcaauuucu

SEQ ID NO: 2315 - RNA, 27 nt, Artificial Sequence
  Synthetic oligonucleotide
cuuggguuuuuccuguggcugaaaaag

SEQ ID NO: 2316 - RNA, 27 nt, Artificial Sequence
  Synthetic oligonucleotide
guggcugaaaaagagaaagcaaauuaa

SEQ ID NO: 2317 - RNA, 27 nt, Artificial Sequence
  Synthetic oligonucleotide
auuaaagaucugggcagugaauuaguu

SEQ ID NO: 2318 - RNA, 27 nt, Artificial Sequence
  Synthetic oligonucleotide
uuaaagaucugggcagugaauuaguuc

SEQ ID NO: 2319 - RNA, 27 nt, Artificial Sequence
  Synthetic oligonucleotide
uaaagaucugggcagugaauuaguucg

SEQ ID NO: 2320 - RNA, 27 nt, Artificial Sequence
  Synthetic oligonucleotide
aaagaucugggcagugaauuaguucgc

SEQ ID NO: 2321 - RNA, 27 nt, Artificial Sequence
  Synthetic oligonucleotide
aagaucugggcagugaauuaguucgcu

SEQ ID NO: 2322 - RNA, 27 nt, Artificial Sequence
  Synthetic oligonucleotide
agaucugggcagugaauuaguucgcua

SEQ ID NO: 2323 - RNA, 27 nt, Artificial Sequence
  Synthetic oligonucleotide
gaucugggcagugaauuaguucgcuac

SEQ ID NO: 2324 - RNA, 27 nt, Artificial Sequence
  Synthetic oligonucleotide
aucugggcagugaauuaguucgcuacg

SEQ ID NO: 2325 - RNA, 27 nt, Artificial Sequence
  Synthetic oligonucleotide
ucugggcagugaauuaguucgcuacga

SEQ ID NO: 2326 - RNA, 27 nt, Artificial Sequence
  Synthetic oligonucleotide
cugggcagugaauuaguucgcuacgau

SEQ ID NO: 2327 - RNA, 27 nt, Artificial Sequence
  Synthetic oligonucleotide
ugggcagugaauuaguucgcuacgaug

SEQ ID NO: 2328 - RNA, 27 nt, Artificial Sequence
  Synthetic oligonucleotide
gggcagugaauuaguucgcuacgaugc

SEQ ID NO: 2329 - RNA, 27 nt, Artificial Sequence
  Synthetic oligonucleotide
cacacuccucauuuggauaggcuugua

SEQ ID NO: 2330 - RNA, 27 nt, Artificial Sequence
  Synthetic oligonucleotide
acacuccucauuuggauaggcuuguaa

SEQ ID NO: 2331 - RNA, 27 nt, Artificial Sequence
  Synthetic oligonucleotide
cacuccucauuuggauaggcuuguaag

SEQ ID NO: 2332 - RNA, 27 nt, Artificial Sequence
  Synthetic oligonucleotide
acuccucauuuggauaggcuuguaagu

SEQ ID NO: 2333 - RNA, 27 nt, Artificial Sequence
  Synthetic oligonucleotide
cuccucauuuggauaggcuuguaagug

SEQ ID NO: 2334 - RNA, 27 nt, Artificial Sequence
  Synthetic oligonucleotide
uccucauuuggauaggcuuguaagugc

SEQ ID NO: 2335 - RNA, 27 nt, Artificial Sequence
  Synthetic oligonucleotide
ccucauuuggauaggcuuguaagugcc

SEQ ID NO: 2336 - RNA, 27 nt, Artificial Sequence
  Synthetic oligonucleotide
cucauuuggauaggcuuguaagugccc

SEQ ID NO: 2337 - RNA, 27 nt, Artificial Sequence
  Synthetic oligonucleotide
ucauuuggauaggcuuguaagugcccg

SEQ ID NO: 2338 - RNA, 27 nt, Artificial Sequence
  Synthetic oligonucleotide
cauuuggauaggcuuguaagugcccga

SEQ ID NO: 2339 - RNA, 27 nt, Artificial Sequence
  Synthetic oligonucleotide
auuuggauaggcuuguaagugcccgaa

SEQ ID NO: 2340 - RNA, 27 nt, Artificial Sequence
  Synthetic oligonucleotide
uuuggauaggcuuguaagugcccgaag

SEQ ID NO: 2341 - RNA, 27 nt, Artificial Sequence
  Synthetic oligonucleotide
uuggauaggcuuguaagugcccgaagu

SEQ ID NO: 2342 - RNA, 27 nt, Artificial Sequence
  Synthetic oligonucleotide
uggauaggcuuguaagugcccgaagug

SEQ ID NO: 2343 - RNA, 27 nt, Artificial Sequence
  Synthetic oligonucleotide
ggauaggcuuguaagugcccgaagugu

SEQ ID NO: 2344 - RNA, 27 nt, Artificial Sequence
  Synthetic oligonucleotide
gauaggcuuguaagugcccgaagugua

SEQ ID NO: 2345 - RNA, 27 nt, Artificial Sequence
  Synthetic oligonucleotide
auaggcuuguaagugcccgaaguguaa

SEQ ID NO: 2346 - RNA, 27 nt, Artificial Sequence
  Synthetic oligonucleotide
uaggcuuguaagugcccgaaguguaag

SEQ ID NO: 2347 - RNA, 27 nt, Artificial Sequence
  Synthetic oligonucleotide
aggcuuguaagugcccgaaguguaagc

SEQ ID NO: 2348 - RNA, 27 nt, Artificial Sequence
  Synthetic oligonucleotide
ggcuuguaagugcccgaaguguaagcc

SEQ ID NO: 2349 - RNA, 27 nt, Artificial Sequence
  Synthetic oligonucleotide
gcuuguaagugcccgaaguguaagccc

SEQ ID NO: 2350 - RNA, 27 nt, Artificial Sequence
  Synthetic oligonucleotide
cuuguaagugcccgaaguguaagccca

SEQ ID NO: 2351 - RNA, 27 nt, Artificial Sequence
  Synthetic oligonucleotide
uuguaagugcccgaaguguaagcccaa

SEQ ID NO: 2352 - RNA, 27 nt, Artificial Sequence
  Synthetic oligonucleotide
uguaagugcccgaaguguaagcccaac

SEQ ID NO: 2353 - RNA, 27 nt, Artificial Sequence
  Synthetic oligonucleotide
ccgagcuacuuuuccagaagaucaguu

SEQ ID NO: 2354 - RNA, 27 nt, Artificial Sequence
  Synthetic oligonucleotide
uccacauugaccucagugcucuaaauc

SEQ ID NO: 2355 - RNA, 27 nt, Artificial Sequence
  Synthetic oligonucleotide
ccacauugaccucagugcucuaaaucc

SEQ ID NO: 2356 - RNA, 27 nt, Artificial Sequence
  Synthetic oligonucleotide
cacauugaccucagugcucuaaaucca

SEQ ID NO: 2357 - RNA, 27 nt, Artificial Sequence
  Synthetic oligonucleotide
acauugaccucagugcucuaaauccag

SEQ ID NO: 2358 - RNA, 27 nt, Artificial Sequence
  Synthetic oligonucleotide
cauugaccucagugcucuaaauccaga

SEQ ID NO: 2359 - RNA, 27 nt, Artificial Sequence
  Synthetic oligonucleotide
auugaccucagugcucuaaauccagag

SEQ ID NO: 2360 - RNA, 27 nt, Artificial Sequence
  Synthetic oligonucleotide
uugaccucagugcucuaaauccagagc

SEQ ID NO: 2361 - RNA, 27 nt, Artificial Sequence
  Synthetic oligonucleotide
ugaccucagugcucuaaauccagagcu

SEQ ID NO: 2362 - RNA, 27 nt, Artificial Sequence
  Synthetic oligonucleotide
gaccucagugcucuaaauccagagcug

SEQ ID NO: 2363 - RNA, 27 nt, Artificial Sequence
  Synthetic oligonucleotide
accucagugcucuaaauccagagcugg

SEQ ID NO: 2364 - RNA, 27 nt, Artificial Sequence
  Synthetic oligonucleotide
ccucagugcucuaaauccagagcuggu

SEQ ID NO: 2365 - RNA, 27 nt, Artificial Sequence
  Synthetic oligonucleotide
cucagugcucuaaauccagagcugguc

SEQ ID NO: 2366 - RNA, 27 nt, Artificial Sequence
  Synthetic oligonucleotide
ucagugcucuaaauccagagcuggucc

SEQ ID NO: 2367 - RNA, 27 nt, Artificial Sequence
  Synthetic oligonucleotide
cagugcucuaaauccagagcuggucca

SEQ ID NO: 2368 - RNA, 27 nt, Artificial Sequence
  Synthetic oligonucleotide
agugcucuaaauccagagcugguccag

SEQ ID NO: 2369 - RNA, 27 nt, Artificial Sequence
  Synthetic oligonucleotide
gugcucuaaauccagagcugguccagg

SEQ ID NO: 2370 - RNA, 27 nt, Artificial Sequence
  Synthetic oligonucleotide
ugcucuaaauccagagcugguccaggc

SEQ ID NO: 2371 - RNA, 27 nt, Artificial Sequence
  Synthetic oligonucleotide
gcucuaaauccagagcugguccaggca

SEQ ID NO: 2372 - RNA, 27 nt, Artificial Sequence
  Synthetic oligonucleotide
cucuaaauccagagcugguccaggcag

SEQ ID NO: 2373 - RNA, 27 nt, Artificial Sequence
  Synthetic oligonucleotide
ucuaaauccagagcugguccaggcagu

SEQ ID NO: 2374 - RNA, 27 nt, Artificial Sequence
  Synthetic oligonucleotide
guagccugauugugcauuucaaugaag

SEQ ID NO: 2375 - RNA, 27 nt, Artificial Sequence
  Synthetic oligonucleotide
uagccugauugugcauuucaaugaagu

SEQ ID NO: 2376 - RNA, 27 nt, Artificial Sequence
  Synthetic oligonucleotide
agccugauugugcauuucaaugaaguc

SEQ ID NO: 2377 - RNA, 27 nt, Artificial Sequence
  Synthetic oligonucleotide
gccugauugugcauuucaaugaaguca

SEQ ID NO: 2378 - RNA, 27 nt, Artificial Sequence
  Synthetic oligonucleotide
ccugauugugcauuucaaugaagucau

SEQ ID NO: 2379 - RNA, 27 nt, Artificial Sequence
  Synthetic oligonucleotide
cugauugugcauuucaaugaagucaua

SEQ ID NO: 2380 - RNA, 27 nt, Artificial Sequence
  Synthetic oligonucleotide
ugauugugcauuucaaugaagucauag

SEQ ID NO: 2381 - RNA, 27 nt, Artificial Sequence
  Synthetic oligonucleotide
gauugugcauuucaaugaagucauagg

SEQ ID NO: 2382 - RNA, 27 nt, Artificial Sequence
  Synthetic oligonucleotide
auugugcauuucaaugaagucauagga

SEQ ID NO: 2383 - RNA, 27 nt, Artificial Sequence
  Synthetic oligonucleotide
uugugcauuucaaugaagucauaggaa

SEQ ID NO: 2384 - RNA, 27 nt, Artificial Sequence
  Synthetic oligonucleotide
ugugcauuucaaugaagucauaggaag

SEQ ID NO: 2385 - RNA, 27 nt, Artificial Sequence
  Synthetic oligonucleotide
gugcauuucaaugaagucauaggaaga

SEQ ID NO: 2386 - RNA, 27 nt, Artificial Sequence
  Synthetic oligonucleotide
ugcauuucaaugaagucauaggaagag

SEQ ID NO: 2387 - RNA, 27 nt, Artificial Sequence
  Synthetic oligonucleotide
gcauuucaaugaagucauaggaagagg

SEQ ID NO: 2388 - RNA, 27 nt, Artificial Sequence
  Synthetic oligonucleotide
cauuucaaugaagucauaggaagaggg

SEQ ID NO: 2389 - RNA, 27 nt, Artificial Sequence
  Synthetic oligonucleotide
auuucaaugaagucauaggaagagggc

SEQ ID NO: 2390 - RNA, 27 nt, Artificial Sequence
  Synthetic oligonucleotide
uuucaaugaagucauaggaagagggca

SEQ ID NO: 2391 - RNA, 27 nt, Artificial Sequence
  Synthetic oligonucleotide
uucaaugaagucauaggaagagggcau

SEQ ID NO: 2392 - RNA, 27 nt, Artificial Sequence
  Synthetic oligonucleotide
ucaaugaagucauaggaagagggcauu

SEQ ID NO: 2393 - RNA, 27 nt, Artificial Sequence
  Synthetic oligonucleotide
caaugaagucauaggaagagggcauuu

SEQ ID NO: 2394 - RNA, 27 nt, Artificial Sequence
  Synthetic oligonucleotide
aaugaagucauaggaagagggcauuuu

SEQ ID NO: 2395 - RNA, 27 nt, Artificial Sequence
  Synthetic oligonucleotide
augaagucauaggaagagggcauuuug

SEQ ID NO: 2396 - RNA, 27 nt, Artificial Sequence
  Synthetic oligonucleotide
ugaagucauaggaagagggcauuuugg

SEQ ID NO: 2397 - RNA, 27 nt, Artificial Sequence
  Synthetic oligonucleotide
gaagucauaggaagagggcauuuuggu

SEQ ID NO: 2398 - RNA, 27 nt, Artificial Sequence
  Synthetic oligonucleotide
aagucauaggaagagggcauuuugguu

SEQ ID NO: 2399 - RNA, 27 nt, Artificial Sequence
  Synthetic oligonucleotide
agucauaggaagagggcauuuugguug

SEQ ID NO: 2400 - RNA, 27 nt, Artificial Sequence
  Synthetic oligonucleotide
gucauaggaagagggcauuuugguugu

SEQ ID NO: 2401 - RNA, 27 nt, Artificial Sequence
  Synthetic oligonucleotide
ucauaggaagagggcauuuugguugug

SEQ ID NO: 2402 - RNA, 27 nt, Artificial Sequence
  Synthetic oligonucleotide
gcaagaaaauucacugugcugugaaau

SEQ ID NO: 2403 - RNA, 27 nt, Artificial Sequence
  Synthetic oligonucleotide
caagaaaauucacugugcugugaaauc

SEQ ID NO: 2404 - RNA, 27 nt, Artificial Sequence
  Synthetic oligonucleotide
aagaaaauucacugugcugugaaaucc

SEQ ID NO: 2405 - RNA, 27 nt, Artificial Sequence
  Synthetic oligonucleotide
agaaaauucacugugcugugaaauccu

SEQ ID NO: 2406 - RNA, 27 nt, Artificial Sequence
  Synthetic oligonucleotide
gaaaauucacugugcugugaaauccuu

SEQ ID NO: 2407 - RNA, 27 nt, Artificial Sequence
  Synthetic oligonucleotide
aaaauucacugugcugugaaauccuug

SEQ ID NO: 2408 - RNA, 27 nt, Artificial Sequence
  Synthetic oligonucleotide
aaauucacugugcugugaaauccuuga

SEQ ID NO: 2409 - RNA, 27 nt, Artificial Sequence
  Synthetic oligonucleotide
aauucacugugcugugaaauccuugaa

SEQ ID NO: 2410 - RNA, 27 nt, Artificial Sequence
  Synthetic oligonucleotide
auucacugugcugugaaauccuugaac

SEQ ID NO: 2411 - RNA, 27 nt, Artificial Sequence
  Synthetic oligonucleotide
uucacugugcugugaaauccuugaaca

SEQ ID NO: 2412 - RNA, 27 nt, Artificial Sequence
  Synthetic oligonucleotide
ucacugugcugugaaauccuugaacag

SEQ ID NO: 2413 - RNA, 27 nt, Artificial Sequence
  Synthetic oligonucleotide
ccgagggaaucaucaugaaagauuuua

SEQ ID NO: 2414 - RNA, 27 nt, Artificial Sequence
  Synthetic oligonucleotide
cgagggaaucaucaugaaagauuuuag

SEQ ID NO: 2415 - RNA, 27 nt, Artificial Sequence
  Synthetic oligonucleotide
augagacucauaauccaacuguaaaag

SEQ ID NO: 2416 - RNA, 27 nt, Artificial Sequence
  Synthetic oligonucleotide
ugagacucauaauccaacuguaaaaga

SEQ ID NO: 2417 - RNA, 27 nt, Artificial Sequence
  Synthetic oligonucleotide
aacuguaaaagaucuuauuggcuuugg

SEQ ID NO: 2418 - RNA, 27 nt, Artificial Sequence
  Synthetic oligonucleotide
uuggcuuuggucuucaaguagccaaag

SEQ ID NO: 2419 - RNA, 27 nt, Artificial Sequence
  Synthetic oligonucleotide
gucuucaaguagccaaaggcaugaaau

SEQ ID NO: 2420 - RNA, 27 nt, Artificial Sequence
  Synthetic oligonucleotide
ucuucaaguagccaaaggcaugaaaua

SEQ ID NO: 2421 - RNA, 27 nt, Artificial Sequence
  Synthetic oligonucleotide
cuucaaguagccaaaggcaugaaauau

SEQ ID NO: 2422 - RNA, 27 nt, Artificial Sequence
  Synthetic oligonucleotide
uucaaguagccaaaggcaugaaauauc

SEQ ID NO: 2423 - RNA, 27 nt, Artificial Sequence
  Synthetic oligonucleotide
ucaaguagccaaaggcaugaaauaucu

SEQ ID NO: 2424 - RNA, 27 nt, Artificial Sequence
  Synthetic oligonucleotide
caaguagccaaaggcaugaaauaucuu

SEQ ID NO: 2425 - RNA, 27 nt, Artificial Sequence
  Synthetic oligonucleotide
aaguagccaaaggcaugaaauaucuug

SEQ ID NO: 2426 - RNA, 27 nt, Artificial Sequence
  Synthetic oligonucleotide
aguagccaaaggcaugaaauaucuugc

SEQ ID NO: 2427 - RNA, 27 nt, Artificial Sequence
  Synthetic oligonucleotide
guagccaaaggcaugaaauaucuugca

SEQ ID NO: 2428 - RNA, 27 nt, Artificial Sequence
  Synthetic oligonucleotide
uagccaaaggcaugaaauaucuugcaa

SEQ ID NO: 2429 - RNA, 27 nt, Artificial Sequence
  Synthetic oligonucleotide
agccaaaggcaugaaauaucuugcaag

SEQ ID NO: 2430 - RNA, 27 nt, Artificial Sequence
  Synthetic oligonucleotide
gccaaaggcaugaaauaucuugcaagc

SEQ ID NO: 2431 - RNA, 27 nt, Artificial Sequence
  Synthetic oligonucleotide
ccaaaggcaugaaauaucuugcaagca

SEQ ID NO: 2432 - RNA, 27 nt, Artificial Sequence
  Synthetic oligonucleotide
caaaggcaugaaauaucuugcaagcaa

SEQ ID NO: 2433 - RNA, 27 nt, Artificial Sequence
  Synthetic oligonucleotide
caagcaaaaaguuuguccacagagacu

SEQ ID NO: 2434 - RNA, 27 nt, Artificial Sequence
  Synthetic oligonucleotide
aagcaaaaaguuuguccacagagacuu

SEQ ID NO: 2435 - RNA, 27 nt, Artificial Sequence
  Synthetic oligonucleotide
agcaaaaaguuuguccacagagacuug

SEQ ID NO: 2436 - RNA, 27 nt, Artificial Sequence
  Synthetic oligonucleotide
gcaaaaaguuuguccacagagacuugg

SEQ ID NO: 2437 - RNA, 27 nt, Artificial Sequence
  Synthetic oligonucleotide
caaaaaguuuguccacagagacuuggc

SEQ ID NO: 2438 - RNA, 27 nt, Artificial Sequence
  Synthetic oligonucleotide
aaaaaguuuguccacagagacuuggcu

SEQ ID NO: 2439 - RNA, 27 nt, Artificial Sequence
  Synthetic oligonucleotide
aaaaguuuguccacagagacuuggcug

SEQ ID NO: 2440 - RNA, 27 nt, Artificial Sequence
  Synthetic oligonucleotide
aaaguuuguccacagagacuuggcugc

SEQ ID NO: 2441 - RNA, 27 nt, Artificial Sequence
  Synthetic oligonucleotide
gacuuggcugcaagaaacuguaugcug

SEQ ID NO: 2442 - RNA, 27 nt, Artificial Sequence
  Synthetic oligonucleotide
cuuggcugcaagaaacuguaugcugga

SEQ ID NO: 2443 - RNA, 27 nt, Artificial Sequence
  Synthetic oligonucleotide
uuggcugcaagaaacuguaugcuggau

SEQ ID NO: 2444 - RNA, 27 nt, Artificial Sequence
  Synthetic oligonucleotide
uggcugcaagaaacuguaugcuggaug

SEQ ID NO: 2445 - RNA, 27 nt, Artificial Sequence
  Synthetic oligonucleotide
ggcugcaagaaacuguaugcuggauga

SEQ ID NO: 2446 - RNA, 27 nt, Artificial Sequence
  Synthetic oligonucleotide
cagucaagguugcugauuuuggucuug

SEQ ID NO: 2447 - RNA, 27 nt, Artificial Sequence
  Synthetic oligonucleotide
aagguugcugauuuuggucuugccaga

SEQ ID NO: 2448 - RNA, 27 nt, Artificial Sequence
  Synthetic oligonucleotide
gguugcugauuuuggucuugccagaga

SEQ ID NO: 2449 - RNA, 27 nt, Artificial Sequence
  Synthetic oligonucleotide
uuggucuugccagagacauguaugaua

SEQ ID NO: 2450 - RNA, 27 nt, Artificial Sequence
  Synthetic oligonucleotide
uggucuugccagagacauguaugauaa

SEQ ID NO: 2451 - RNA, 27 nt, Artificial Sequence
  Synthetic oligonucleotide
aagcugccagugaaguggauggcuuug

SEQ ID NO: 2452 - RNA, 27 nt, Artificial Sequence
  Synthetic oligonucleotide
agcugccagugaaguggauggcuuugg

SEQ ID NO: 2453 - RNA, 27 nt, Artificial Sequence
  Synthetic oligonucleotide
aaguggauggcuuuggaaagucugcaa

SEQ ID NO: 2454 - RNA, 27 nt, Artificial Sequence
  Synthetic oligonucleotide
guggauggcuuuggaaagucugcaaac

SEQ ID NO: 2455 - RNA, 27 nt, Artificial Sequence
  Synthetic oligonucleotide
gcuuuggaaagucugcaaacucaaaag

SEQ ID NO: 2456 - RNA, 27 nt, Artificial Sequence
  Synthetic oligonucleotide
uccuuuggcgugcuccucugggagcug

SEQ ID NO: 2457 - RNA, 27 nt, Artificial Sequence
  Synthetic oligonucleotide
cuuuggcgugcuccucugggagcugau

SEQ ID NO: 2458 - RNA, 27 nt, Artificial Sequence
  Synthetic oligonucleotide
uuuggcgugcuccucugggagcugaug

SEQ ID NO: 2459 - RNA, 27 nt, Artificial Sequence
  Synthetic oligonucleotide
uuggcgugcuccucugggagcugauga

SEQ ID NO: 2460 - RNA, 27 nt, Artificial Sequence
  Synthetic oligonucleotide
uggcgugcuccucugggagcugaugac

SEQ ID NO: 2461 - RNA, 27 nt, Artificial Sequence
  Synthetic oligonucleotide
augugaacgcuacuuaugugaacguaa

SEQ ID NO: 2462 - RNA, 27 nt, Artificial Sequence
  Synthetic oligonucleotide
ugugaacgcuacuuaugugaacguaaa

SEQ ID NO: 2463 - RNA, 27 nt, Artificial Sequence
  Synthetic oligonucleotide
cucuguugucaucagaagauaacgcug

SEQ ID NO: 2464 - RNA, 27 nt, Artificial Sequence
  Synthetic oligonucleotide
cuuugcucuugccaaaauugcacuauu

SEQ ID NO: 2465 - RNA, 27 nt, Artificial Sequence
  Synthetic oligonucleotide
guauuguuauuuaaauuacuggauucu

SEQ ID NO: 2466 - RNA, 27 nt, Artificial Sequence
  Synthetic oligonucleotide
uacuggauucuaaggaauuucuuaucu

SEQ ID NO: 2467 - RNA, 27 nt, Artificial Sequence
  Synthetic oligonucleotide
acuggauucuaaggaauuucuuaucug

SEQ ID NO: 2468 - RNA, 27 nt, Artificial Sequence
  Synthetic oligonucleotide
uggguugaauuuuuuaaaaaucaggua

SEQ ID NO: 2469 - RNA, 27 nt, Artificial Sequence
  Synthetic oligonucleotide
guaaacauucccuuuuaaauguuuguu

SEQ ID NO: 2470 - RNA, 27 nt, Artificial Sequence
  Synthetic oligonucleotide
uuuuaaauguuuguuuguuuuuugaga

SEQ ID NO: 2471 - RNA, 27 nt, Artificial Sequence
  Synthetic oligonucleotide
caggaucucacucuguugccagggcug

SEQ ID NO: 2472 - RNA, 27 nt, Artificial Sequence
  Synthetic oligonucleotide
ggaucucacucuguugccagggcugua

SEQ ID NO: 2473 - RNA, 27 nt, Artificial Sequence
  Synthetic oligonucleotide
cucacucuguugccagggcuguagugc

SEQ ID NO: 2474 - RNA, 27 nt, Artificial Sequence
  Synthetic oligonucleotide
cacucuguugccagggcuguagugcag

SEQ ID NO: 2475 - RNA, 27 nt, Artificial Sequence
  Synthetic oligonucleotide
cuguugccagggcuguagugcaguggu

SEQ ID NO: 2476 - RNA, 27 nt, Artificial Sequence
  Synthetic oligonucleotide
ggcuguagugcaguggugugaucauag

SEQ ID NO: 2477 - RNA, 27 nt, Artificial Sequence
  Synthetic oligonucleotide
gugcaguggugugaucauagcucacug

SEQ ID NO: 2478 - RNA, 27 nt, Artificial Sequence
  Synthetic oligonucleotide
ccggcuaauuuuuguauuuuuuguaga

SEQ ID NO: 2479 - RNA, 27 nt, Artificial Sequence
  Synthetic oligonucleotide
ccuuauaaauuuuuguauagacauucc

SEQ ID NO: 2480 - RNA, 27 nt, Artificial Sequence
  Synthetic oligonucleotide
guuggaagaauauuuauaggcaauaca

SEQ ID NO: 2481 - RNA, 27 nt, Artificial Sequence
  Synthetic oligonucleotide
cacacaaaacauguuuauaaaugaaca

SEQ ID NO: 2482 - RNA, 27 nt, Artificial Sequence
  Synthetic oligonucleotide
augacauuaagaaaauuuguaugaaau

SEQ ID NO: 2483 - RNA, 27 nt, Artificial Sequence
  Synthetic oligonucleotide
uuguguguauuuuuuuaaaugaaaacu

SEQ ID NO: 2484 - RNA, 27 nt, Artificial Sequence
  Synthetic oligonucleotide
aacucagcauguuuguaaagcaggaua

SEQ ID NO: 2485 - RNA, 27 nt, Artificial Sequence
  Synthetic oligonucleotide
uggauggauugaaaagauuagccucug

SEQ ID NO: 2486 - RNA, 27 nt, Artificial Sequence
  Synthetic oligonucleotide
auucuguggaauuuugugcuugcuacu

SEQ ID NO: 2487 - RNA, 27 nt, Artificial Sequence
  Synthetic oligonucleotide
uucuguggaauuuugugcuugcuacug

SEQ ID NO: 2488 - RNA, 27 nt, Artificial Sequence
  Synthetic oligonucleotide
cuguggaauuuugugcuugcuacugua

SEQ ID NO: 2489 - RNA, 27 nt, Artificial Sequence
  Synthetic oligonucleotide
uggaauuuugugcuugcuacuguauag

SEQ ID NO: 2490 - RNA, 27 nt, Artificial Sequence
  Synthetic oligonucleotide
aauuuugugcuugcuacuguauagugc

SEQ ID NO: 2491 - RNA, 27 nt, Artificial Sequence
  Synthetic oligonucleotide
uuuugugcuugcuacuguauagugcau

SEQ ID NO: 2492 - RNA, 27 nt, Artificial Sequence
  Synthetic oligonucleotide
uuugugcuugcuacuguauagugcaug

SEQ ID NO: 2493 - RNA, 27 nt, Artificial Sequence
  Synthetic oligonucleotide
uugugcuugcuacuguauagugcaugu

SEQ ID NO: 2494 - RNA, 27 nt, Artificial Sequence
  Synthetic oligonucleotide
ugugcuugcuacuguauagugcaugug

SEQ ID NO: 2495 - RNA, 27 nt, Artificial Sequence
  Synthetic oligonucleotide
gugcuugcuacuguauagugcaugugg

SEQ ID NO: 2496 - RNA, 27 nt, Artificial Sequence
  Synthetic oligonucleotide
gcuugcuacuguauagugcauguggug

SEQ ID NO: 2497 - RNA, 27 nt, Artificial Sequence
  Synthetic oligonucleotide
uugcuacuguauagugcauguggugua

SEQ ID NO: 2498 - RNA, 27 nt, Artificial Sequence
  Synthetic oligonucleotide
ugcuacuguauagugcaugugguguag

SEQ ID NO: 2499 - RNA, 27 nt, Artificial Sequence
  Synthetic oligonucleotide
gcuacuguauagugcaugugguguagg

SEQ ID NO: 2500 - RNA, 27 nt, Artificial Sequence
  Synthetic oligonucleotide
uaaacauuuaaaguguuauauuuuuua

SEQ ID NO: 2501 - RNA, 27 nt, Artificial Sequence
  Synthetic oligonucleotide
uaaaaauguuuauuuuuaaugauauga

SEQ ID NO: 2502 - RNA, 27 nt, Artificial Sequence
  Synthetic oligonucleotide
aaaaauguuuauuuuuaaugauaugag

SEQ ID NO: 2503 - RNA, 27 nt, Artificial Sequence
  Synthetic oligonucleotide
aaaauguuuauuuuuaaugauaugaga

SEQ ID NO: 2504 - RNA, 27 nt, Artificial Sequence
  Synthetic oligonucleotide
gcacugugaacauuuuagaaaagguau

SEQ ID NO: 2505 - RNA, 27 nt, Artificial Sequence
  Synthetic oligonucleotide
gcgauaaggaaauguacugauugccaa

SEQ ID NO: 2506 - RNA, 27 nt, Artificial Sequence
  Synthetic oligonucleotide
cgauaaggaaauguacugauugccaau

SEQ ID NO: 2507 - RNA, 27 nt, Artificial Sequence
  Synthetic oligonucleotide
gauaaggaaauguacugauugccaaua

SEQ ID NO: 2508 - RNA, 27 nt, Artificial Sequence
  Synthetic oligonucleotide
auaaggaaauguacugauugccaauac

SEQ ID NO: 2509 - RNA, 27 nt, Artificial Sequence
  Synthetic oligonucleotide
uaaggaaauguacugauugccaauaca

SEQ ID NO: 2510 - RNA, 27 nt, Artificial Sequence
  Synthetic oligonucleotide
aaggaaauguacugauugccaauacac

SEQ ID NO: 2511 - RNA, 27 nt, Artificial Sequence
  Synthetic oligonucleotide
aucaggacuugaagccaaggguuaacc

SEQ ID NO: 2512 - RNA, 27 nt, Artificial Sequence
  Synthetic oligonucleotide
ucaggacuugaagccaaggguuaaccc

SEQ ID NO: 2513 - RNA, 27 nt, Artificial Sequence
  Synthetic oligonucleotide
caggacuugaagccaaggguuaaccca

SEQ ID NO: 2514 - RNA, 27 nt, Artificial Sequence
  Synthetic oligonucleotide
aggacuugaagccaaggguuaacccag

SEQ ID NO: 2515 - RNA, 27 nt, Artificial Sequence
  Synthetic oligonucleotide
ggacuugaagccaaggguuaacccagc

SEQ ID NO: 2516 - RNA, 27 nt, Artificial Sequence
  Synthetic oligonucleotide
ugccguuucauaaauguaauaaguaau

SEQ ID NO: 2517 - RNA, 27 nt, Artificial Sequence
  Synthetic oligonucleotide
uuugcuauuuauaaacuuguccuuaga

SEQ ID NO: 2518 - RNA, 27 nt, Artificial Sequence
  Synthetic oligonucleotide
acuugucacugccuauaccugcagcug

SEQ ID NO: 2519 - RNA, 27 nt, Artificial Sequence
  Synthetic oligonucleotide
cuugucacugccuauaccugcagcuga

SEQ ID NO: 2520 - RNA, 27 nt, Artificial Sequence
  Synthetic oligonucleotide
uugucacugccuauaccugcagcugaa

SEQ ID NO: 2521 - DNA, 25 bp, Artificial Sequence
  Synthetic oligonucleotide
gccucgccgcccgcagcguccgagc

SEQ ID NO: 2522 - DNA, 25 bp, Artificial Sequence
  Synthetic oligonucleotide
gugcggagccagaugcugggcgacc

SEQ ID NO: 2523 - DNA, 25 bp, Artificial Sequence
  Synthetic oligonucleotide
ggagccagaugcugggcgaccgctg

SEQ ID NO: 2524 - DNA, 25 bp, Artificial Sequence
  Synthetic oligonucleotide
augcugggcgaccgcugacucgctg

SEQ ID NO: 2525 - DNA, 25 bp, Artificial Sequence
  Synthetic oligonucleotide
ugcugggcgaccgcugacucgcugg

SEQ ID NO: 2526 - DNA, 25 bp, Artificial Sequence
  Synthetic oligonucleotide
cugggcgaccgcugacucgcuggag

SEQ ID NO: 2527 - DNA, 25 bp, Artificial Sequence
  Synthetic oligonucleotide
cagccggcugacuucggcgccgcgc

SEQ ID NO: 2528 - DNA, 25 bp, Artificial Sequence
  Synthetic oligonucleotide
gccggcugacuucggcgccgcgcgc

SEQ ID NO: 2529 - DNA, 25 bp, Artificial Sequence
  Synthetic oligonucleotide
cggcugacuucggcgccgcgcgctc

SEQ ID NO: 2530 - DNA, 25 bp, Artificial Sequence
  Synthetic oligonucleotide
gcugacgguguagcagaacgcuugg

SEQ ID NO: 2531 - DNA, 25 bp, Artificial Sequence
  Synthetic oligonucleotide
cugacgguguagcagaacgcuuggc

SEQ ID NO: 2532 - DNA, 25 bp, Artificial Sequence
  Synthetic oligonucleotide
ggcaccuggcauucuggugcugctg

SEQ ID NO: 2533 - DNA, 25 bp, Artificial Sequence
  Synthetic oligonucleotide
caccuggcauucuggugcugcugtt

SEQ ID NO: 2534 - DNA, 25 bp, Artificial Sequence
  Synthetic oligonucleotide
accuggcauucuggugcugcugutg

SEQ ID NO: 2535 - DNA, 25 bp, Artificial Sequence
  Synthetic oligonucleotide
cuggugcugcuguuguccuuggugc

SEQ ID NO: 2536 - DNA, 25 bp, Artificial Sequence
  Synthetic oligonucleotide
ggugcugcuguuguccuuggugcag

SEQ ID NO: 2537 - DNA, 25 bp, Artificial Sequence
  Synthetic oligonucleotide
gugcugcuguuguccuuggugcaga

SEQ ID NO: 2538 - DNA, 25 bp, Artificial Sequence
  Synthetic oligonucleotide
cugcuguuguccuuggugcagagga

SEQ ID NO: 2539 - DNA, 25 bp, Artificial Sequence
  Synthetic oligonucleotide
guuccguagacucuggguugcactc

SEQ ID NO: 2540 - DNA, 25 bp, Artificial Sequence
  Synthetic oligonucleotide
gcacuguuucaauaggacccugctg

SEQ ID NO: 2541 - DNA, 25 bp, Artificial Sequence
  Synthetic oligonucleotide
acucuuccggcugugaagcgcgcag

SEQ ID NO: 2542 - DNA, 25 bp, Artificial Sequence
  Synthetic oligonucleotide
ucuuccggcugugaagcgcgcagtg

SEQ ID NO: 2543 - DNA, 25 bp, Artificial Sequence
  Synthetic oligonucleotide
uaccacggcuuugcagcgcgucgac

SEQ ID NO: 2544 - DNA, 25 bp, Artificial Sequence
  Synthetic oligonucleotide
ccacggcuuugcagcgcgucgactt

SEQ ID NO: 2545 - DNA, 25 bp, Artificial Sequence
  Synthetic oligonucleotide
cggcuuugcagcgcgucgacuuatt

SEQ ID NO: 2546 - DNA, 25 bp, Artificial Sequence
  Synthetic oligonucleotide
gcuuugcagcgcgucgacuuauuca

SEQ ID NO: 2547 - DNA, 25 bp, Artificial Sequence
  Synthetic oligonucleotide
cuuugcagcgcgucgacuuauucat

SEQ ID NO: 2548 - DNA, 25 bp, Artificial Sequence
  Synthetic oligonucleotide
uuugcagcgcgucgacuuauucatg

SEQ ID NO: 2549 - DNA, 25 bp, Artificial Sequence
  Synthetic oligonucleotide
uugcagcgcgucgacuuauucaugg

SEQ ID NO: 2550 - DNA, 25 bp, Artificial Sequence
  Synthetic oligonucleotide
gcgucgacuuauucaugggccggct

SEQ ID NO: 2551 - DNA, 25 bp, Artificial Sequence
  Synthetic oligonucleotide
cgcuucaugcagguggugcucuctc

SEQ ID NO: 2552 - DNA, 25 bp, Artificial Sequence
  Synthetic oligonucleotide
guggugcucucucgaacagcacacc

SEQ ID NO: 2553 - DNA, 25 bp, Artificial Sequence
  Synthetic oligonucleotide
ggugcucucucgaacagcacacctc

SEQ ID NO: 2554 - DNA, 25 bp, Artificial Sequence
  Synthetic oligonucleotide
gcuuggcaacgagagcuguaccutg

SEQ ID NO: 2555 - DNA, 25 bp, Artificial Sequence
  Synthetic oligonucleotide
cacuacuccuucacugaaacagctg

SEQ ID NO: 2556 - DNA, 25 bp, Artificial Sequence
  Synthetic oligonucleotide
caagcagucucuucaacuguucutg

SEQ ID NO: 2557 - DNA, 25 bp, Artificial Sequence
  Synthetic oligonucleotide
aagcagucucuucaacuguucuugg

SEQ ID NO: 2558 - DNA, 25 bp, Artificial Sequence
  Synthetic oligonucleotide
gucucuucaacuguucuuggaaaag

SEQ ID NO: 2559 - DNA, 25 bp, Artificial Sequence
  Synthetic oligonucleotide
agcacguagugauuggacccagcag

SEQ ID NO: 2560 - DNA, 25 bp, Artificial Sequence
  Synthetic oligonucleotide
gacccagcagccugauugugcautt

SEQ ID NO: 2561 - DNA, 25 bp, Artificial Sequence
  Synthetic oligonucleotide
gucaagguugcugauuucggucutg

SEQ ID NO: 2562 - DNA, 25 bp, Artificial Sequence
  Synthetic oligonucleotide
uugcugauuucggucuugccagaga

SEQ ID NO: 2563 - DNA, 25 bp, Artificial Sequence
  Synthetic oligonucleotide
gccaagcuaccaguaaaguggaugg

SEQ ID NO: 2564 - DNA, 25 bp, Artificial Sequence
  Synthetic oligonucleotide
agcuaccaguaaaguggauggcutt

SEQ ID NO: 2565 - DNA, 25 bp, Artificial Sequence
  Synthetic oligonucleotide
gcuaccaguaaaguggauggcuuta

SEQ ID NO: 2566 - DNA, 25 bp, Artificial Sequence
  Synthetic oligonucleotide
uuggugugcuccucugggagcucat

SEQ ID NO: 2567 - DNA, 25 bp, Artificial Sequence
  Synthetic oligonucleotide
uggugugcuccucugggagcucatg

SEQ ID NO: 2568 - DNA, 25 bp, Artificial Sequence
  Synthetic oligonucleotide
gugugcuccucugggagcucaugac

SEQ ID NO: 2569 - DNA, 25 bp, Artificial Sequence
  Synthetic oligonucleotide
uuguuuuguuuuuuguuuugcuutt

SEQ ID NO: 2570 - DNA, 25 bp, Artificial Sequence
  Synthetic oligonucleotide
uguuuuguuuuuuguuuugcuuutg

SEQ ID NO: 2571 - DNA, 25 bp, Artificial Sequence
  Synthetic oligonucleotide
guuuuguuuuuuguuuugcuuuugc

SEQ ID NO: 2572 - DNA, 25 bp, Artificial Sequence
  Synthetic oligonucleotide
uuuuguuuuuuguuuugcuuuugcg

SEQ ID NO: 2573 - DNA, 25 bp, Artificial Sequence
  Synthetic oligonucleotide
uuuguuuuuuguuuugcuuuugcgg

SEQ ID NO: 2574 - DNA, 25 bp, Artificial Sequence
  Synthetic oligonucleotide
uguuuuuuguuuugcuuuugcggta

SEQ ID NO: 2575 - DNA, 25 bp, Artificial Sequence
  Synthetic oligonucleotide
guuuuuuguuuugcuuuugcgguaa

SEQ ID NO: 2576 - DNA, 25 bp, Artificial Sequence
  Synthetic oligonucleotide
uuuuuuguuuugcuuuugcgguaac

SEQ ID NO: 2577 - DNA, 25 bp, Artificial Sequence
  Synthetic oligonucleotide
uuuuuguuuugcuuuugcgguaact

SEQ ID NO: 2578 - DNA, 25 bp, Artificial Sequence
  Synthetic oligonucleotide
uuuuguuuugcuuuugcgguaactg

SEQ ID NO: 2579 - DNA, 25 bp, Artificial Sequence
  Synthetic oligonucleotide
uuuguuuugcuuuugcgguaacugc

SEQ ID NO: 2580 - DNA, 25 bp, Artificial Sequence
  Synthetic oligonucleotide
uuguuuugcuuuugcgguaacugca

SEQ ID NO: 2581 - DNA, 25 bp, Artificial Sequence
  Synthetic oligonucleotide
uguuuugcuuuugcgguaacugcac

SEQ ID NO: 2582 - DNA, 25 bp, Artificial Sequence
  Synthetic oligonucleotide
guuuugcuuuugcgguaacugcacc

SEQ ID NO: 2583 - DNA, 25 bp, Artificial Sequence
  Synthetic oligonucleotide
uuuugcuuuugcgguaacugcacca

SEQ ID NO: 2584 - DNA, 25 bp, Artificial Sequence
  Synthetic oligonucleotide
uuugcuuuugcgguaacugcaccac

SEQ ID NO: 2585 - DNA, 25 bp, Artificial Sequence
  Synthetic oligonucleotide
uugcuuuugcgguaacugcaccact

SEQ ID NO: 2586 - DNA, 25 bp, Artificial Sequence
  Synthetic oligonucleotide
cuuuugcgguaacugcaccacuatg

SEQ ID NO: 2587 - DNA, 25 bp, Artificial Sequence
  Synthetic oligonucleotide
cccagcuguuuagcaaggagugutg

SEQ ID NO: 2588 - DNA, 25 bp, Artificial Sequence
  Synthetic oligonucleotide
gcuguuuagcaaggaguguuggctc

SEQ ID NO: 2589 - DNA, 25 bp, Artificial Sequence
  Synthetic oligonucleotide
uugugcuuacuacuguauagugcat

SEQ ID NO: 2590 - DNA, 25 bp, Artificial Sequence
  Synthetic oligonucleotide
ugugcuuacuacuguauagugcatg

SEQ ID NO: 2591 - DNA, 25 bp, Artificial Sequence
  Synthetic oligonucleotide
gugcuuacuacuguauagugcaugt

SEQ ID NO: 2592 - DNA, 25 bp, Artificial Sequence
  Synthetic oligonucleotide
gcuuacuacuguauagugcaugugg

SEQ ID NO: 2593 - RNA, 27 nt, Artificial Sequence
  Synthetic oligonucleotide
gcucggacgcugcgggcggcgaggccg

SEQ ID NO: 2594 - RNA, 27 nt, Artificial Sequence
  Synthetic oligonucleotide
ggucgcccagcaucuggcuccgcacag

SEQ ID NO: 2595 - RNA, 27 nt, Artificial Sequence
  Synthetic oligonucleotide
cagcggucgcccagcaucuggcuccgc

SEQ ID NO: 2596 - RNA, 27 nt, Artificial Sequence
  Synthetic oligonucleotide
cagcgagucagcggucgcccagcaucu

SEQ ID NO: 2597 - RNA, 27 nt, Artificial Sequence
  Synthetic oligonucleotide
ccagcgagucagcggucgcccagcauc

SEQ ID NO: 2598 - RNA, 27 nt, Artificial Sequence
  Synthetic oligonucleotide
cuccagcgagucagcggucgcccagca

SEQ ID NO: 2599 - RNA, 27 nt, Artificial Sequence
  Synthetic oligonucleotide
gcgcggcgccgaagucagccggcuggg

SEQ ID NO: 2600 - RNA, 27 nt, Artificial Sequence
  Synthetic oligonucleotide
gcgcgcggcgccgaagucagccggcug

SEQ ID NO: 2601 - RNA, 27 nt, Artificial Sequence
  Synthetic oligonucleotide
gagcgcgcggcgccgaagucagccggc

SEQ ID NO: 2602 - RNA, 27 nt, Artificial Sequence
  Synthetic oligonucleotide
ccaagcguucugcuacaccgucagcuu

SEQ ID NO: 2603 - RNA, 27 nt, Artificial Sequence
  Synthetic oligonucleotide
gccaagcguucugcuacaccgucagcu

SEQ ID NO: 2604 - RNA, 27 nt, Artificial Sequence
  Synthetic oligonucleotide
cagcagcaccagaaugccaggugccag

SEQ ID NO: 2605 - RNA, 27 nt, Artificial Sequence
  Synthetic oligonucleotide
aacagcagcaccagaaugccaggugcc

SEQ ID NO: 2606 - RNA, 27 nt, Artificial Sequence
  Synthetic oligonucleotide
caacagcagcaccagaaugccaggugc

SEQ ID NO: 2607 - RNA, 27 nt, Artificial Sequence
  Synthetic oligonucleotide
gcaccaaggacaacagcagcaccagaa

SEQ ID NO: 2608 - RNA, 27 nt, Artificial Sequence
  Synthetic oligonucleotide
cugcaccaaggacaacagcagcaccag

SEQ ID NO: 2609 - RNA, 27 nt, Artificial Sequence
  Synthetic oligonucleotide
ucugcaccaaggacaacagcagcacca

SEQ ID NO: 2610 - RNA, 27 nt, Artificial Sequence
  Synthetic oligonucleotide
uccucugcaccaaggacaacagcagca

SEQ ID NO: 2611 - RNA, 27 nt, Artificial Sequence
  Synthetic oligonucleotide
gagugcaacccagagucuacggaacag

SEQ ID NO: 2612 - RNA, 27 nt, Artificial Sequence
  Synthetic oligonucleotide
cagcaggguccuauugaaacagugcuc

SEQ ID NO: 2613 - RNA, 27 nt, Artificial Sequence
  Synthetic oligonucleotide
cugcgcgcuucacagccggaagaguuu

SEQ ID NO: 2614 - RNA, 27 nt, Artificial Sequence
  Synthetic oligonucleotide
cacugcgcgcuucacagccggaagagu

SEQ ID NO: 2615 - RNA, 27 nt, Artificial Sequence
  Synthetic oligonucleotide
gucgacgcgcugcaaagccgugguaaa

SEQ ID NO: 2616 - RNA, 27 nt, Artificial Sequence
  Synthetic oligonucleotide
aagucgacgcgcugcaaagccguggua

SEQ ID NO: 2617 - RNA, 27 nt, Artificial Sequence
  Synthetic oligonucleotide
aauaagucgacgcgcugcaaagccgug

SEQ ID NO: 2618 - RNA, 27 nt, Artificial Sequence
  Synthetic oligonucleotide
ugaauaagucgacgcgcugcaaagccg

SEQ ID NO: 2619 - RNA, 27 nt, Artificial Sequence
  Synthetic oligonucleotide
augaauaagucgacgcgcugcaaagcc

SEQ ID NO: 2620 - RNA, 27 nt, Artificial Sequence
  Synthetic oligonucleotide
caugaauaagucgacgcgcugcaaagc

SEQ ID NO: 2621 - RNA, 27 nt, Artificial Sequence
  Synthetic oligonucleotide
ccaugaauaagucgacgcgcugcaaag

SEQ ID NO: 2622 - RNA, 27 nt, Artificial Sequence
  Synthetic oligonucleotide
agccggcccaugaauaagucgacgcgc

SEQ ID NO: 2623 - RNA, 27 nt, Artificial Sequence
  Synthetic oligonucleotide
gagagagcaccaccugcaugaagcgac

SEQ ID NO: 2624 - RNA, 27 nt, Artificial Sequence
  Synthetic oligonucleotide
ggugugcuguucgagagagcaccaccu

SEQ ID NO: 2625 - RNA, 27 nt, Artificial Sequence
  Synthetic oligonucleotide
gaggugugcuguucgagagagcaccac

SEQ ID NO: 2626 - RNA, 27 nt, Artificial Sequence
  Synthetic oligonucleotide
caagguacagcucucguugccaagcag

SEQ ID NO: 2627 - RNA, 27 nt, Artificial Sequence
  Synthetic oligonucleotide
cagcuguuucagugaaggaguagugca

SEQ ID NO: 2628 - RNA, 27 nt, Artificial Sequence
  Synthetic oligonucleotide
caagaacaguugaagagacugcuugcu

SEQ ID NO: 2629 - RNA, 27 nt, Artificial Sequence
  Synthetic oligonucleotide
ccaagaacaguugaagagacugcuugc

SEQ ID NO: 2630 - RNA, 27 nt, Artificial Sequence
  Synthetic oligonucleotide
cuuuuccaagaacaguugaagagacug

SEQ ID NO: 2631 - RNA, 27 nt, Artificial Sequence
  Synthetic oligonucleotide
cugcuggguccaaucacuacgugcuga

SEQ ID NO: 2632 - RNA, 27 nt, Artificial Sequence
  Synthetic oligonucleotide
aaaugcacaaucaggcugcugggucca

SEQ ID NO: 2633 - RNA, 27 nt, Artificial Sequence
  Synthetic oligonucleotide
caagaccgaaaucagcaaccuugacag

SEQ ID NO: 2634 - RNA, 27 nt, Artificial Sequence
  Synthetic oligonucleotide
ucucuggcaagaccgaaaucagcaacc

SEQ ID NO: 2635 - RNA, 27 nt, Artificial Sequence
  Synthetic oligonucleotide
ccauccacuuuacugguagcuuggcac

SEQ ID NO: 2636 - RNA, 27 nt, Artificial Sequence
  Synthetic oligonucleotide
aaagccauccacuuuacugguagcuug

SEQ ID NO: 2637 - RNA, 27 nt, Artificial Sequence
  Synthetic oligonucleotide
uaaagccauccacuuuacugguagcuu

SEQ ID NO: 2638 - RNA, 27 nt, Artificial Sequence
  Synthetic oligonucleotide
augagcucccagaggagcacaccaaag

SEQ ID NO: 2639 - RNA, 27 nt, Artificial Sequence
  Synthetic oligonucleotide
caugagcucccagaggagcacaccaaa

SEQ ID NO: 2640 - RNA, 27 nt, Artificial Sequence
  Synthetic oligonucleotide
gucaugagcucccagaggagcacacca

SEQ ID NO: 2641 - RNA, 27 nt, Artificial Sequence
  Synthetic oligonucleotide
aaaagcaaaacaaaaaacaaaacaaaa

SEQ ID NO: 2642 - RNA, 27 nt, Artificial Sequence
  Synthetic oligonucleotide
caaaagcaaaacaaaaaacaaaacaaa

SEQ ID NO: 2643 - RNA, 27 nt, Artificial Sequence
  Synthetic oligonucleotide
gcaaaagcaaaacaaaaaacaaaacaa

SEQ ID NO: 2644 - RNA, 27 nt, Artificial Sequence
  Synthetic oligonucleotide
cgcaaaagcaaaacaaaaaacaaaaca

SEQ ID NO: 2645 - RNA, 27 nt, Artificial Sequence
  Synthetic oligonucleotide
ccgcaaaagcaaaacaaaaaacaaaac

SEQ ID NO: 2646 - RNA, 27 nt, Artificial Sequence
  Synthetic oligonucleotide
uaccgcaaaagcaaaacaaaaaacaaa

SEQ ID NO: 2647 - RNA, 27 nt, Artificial Sequence
  Synthetic oligonucleotide
uuaccgcaaaagcaaaacaaaaaacaa

SEQ ID NO: 2648 - RNA, 27 nt, Artificial Sequence
  Synthetic oligonucleotide
guuaccgcaaaagcaaaacaaaaaaca

SEQ ID NO: 2649 - RNA, 27 nt, Artificial Sequence
  Synthetic oligonucleotide
aguuaccgcaaaagcaaaacaaaaaac

SEQ ID NO: 2650 - RNA, 27 nt, Artificial Sequence
  Synthetic oligonucleotide
caguuaccgcaaaagcaaaacaaaaaa

SEQ ID NO: 2651 - RNA, 27 nt, Artificial Sequence
  Synthetic oligonucleotide
gcaguuaccgcaaaagcaaaacaaaaa

SEQ ID NO: 2652 - RNA, 27 nt, Artificial Sequence
  Synthetic oligonucleotide
ugcaguuaccgcaaaagcaaaacaaaa

SEQ ID NO: 2653 - RNA, 27 nt, Artificial Sequence
  Synthetic oligonucleotide
gugcaguuaccgcaaaagcaaaacaaa

SEQ ID NO: 2654 - RNA, 27 nt, Artificial Sequence
  Synthetic oligonucleotide
ggugcaguuaccgcaaaagcaaaacaa

SEQ ID NO: 2655 - RNA, 27 nt, Artificial Sequence
  Synthetic oligonucleotide
uggugcaguuaccgcaaaagcaaaaca

SEQ ID NO: 2656 - RNA, 27 nt, Artificial Sequence
  Synthetic oligonucleotide
guggugcaguuaccgcaaaagcaaaac

SEQ ID NO: 2657 - RNA, 27 nt, Artificial Sequence
  Synthetic oligonucleotide
aguggugcaguuaccgcaaaagcaaaa

SEQ ID NO: 2658 - RNA, 27 nt, Artificial Sequence
  Synthetic oligonucleotide
cauaguggugcaguuaccgcaaaagca

SEQ ID NO: 2659 - RNA, 27 nt, Artificial Sequence
  Synthetic oligonucleotide
caacacuccuugcuaaacagcuggguu

SEQ ID NO: 2660 - RNA, 27 nt, Artificial Sequence
  Synthetic oligonucleotide
gagccaacacuccuugcuaaacagcug

SEQ ID NO: 2661 - RNA, 27 nt, Artificial Sequence
  Synthetic oligonucleotide
augcacuauacaguaguaagcacaaaa

SEQ ID NO: 2662 - RNA, 27 nt, Artificial Sequence
  Synthetic oligonucleotide
caugcacuauacaguaguaagcacaaa

SEQ ID NO: 2663 - RNA, 27 nt, Artificial Sequence
  Synthetic oligonucleotide
acaugcacuauacaguaguaagcacaa

SEQ ID NO: 2664 - RNA, 27 nt, Artificial Sequence
  Synthetic oligonucleotide
ccacaugcacuauacaguaguaagcac

SEQ ID NO: 2665 - DNA, 27 bp, Artificial Sequence
  Synthetic oligonucleotide
cggcctcgccgcccgcagcgtccgagc

SEQ ID NO: 2666 - DNA, 27 bp, Artificial Sequence
  Synthetic oligonucleotide
ctgtgcggagccagatgctgggcgacc

SEQ ID NO: 2667 - DNA, 27 bp, Artificial Sequence
  Synthetic oligonucleotide
gcggagccagatgctgggcgaccgctg

SEQ ID NO: 2668 - DNA, 27 bp, Artificial Sequence
  Synthetic oligonucleotide
agatgctgggcgaccgctgactcgctg

SEQ ID NO: 2669 - DNA, 27 bp, Artificial Sequence
  Synthetic oligonucleotide
gatgctgggcgaccgctgactcgctgg

SEQ ID NO: 2670 - DNA, 27 bp, Artificial Sequence
  Synthetic oligonucleotide
tgctgggcgaccgctgactcgctggag

SEQ ID NO: 2671 - DNA, 27 bp, Artificial Sequence
  Synthetic oligonucleotide
cccagccggctgacttcggcgccgcgc

SEQ ID NO: 2672 - DNA, 27 bp, Artificial Sequence
  Synthetic oligonucleotide
cagccggctgacttcggcgccgcgcgc

SEQ ID NO: 2673 - DNA, 27 bp, Artificial Sequence
  Synthetic oligonucleotide
gccggctgacttcggcgccgcgcgctc

SEQ ID NO: 2674 - DNA, 27 bp, Artificial Sequence
  Synthetic oligonucleotide
aagctgacggtgtagcagaacgcttgg

SEQ ID NO: 2675 - DNA, 27 bp, Artificial Sequence
  Synthetic oligonucleotide
agctgacggtgtagcagaacgcttggc

SEQ ID NO: 2676 - DNA, 27 bp, Artificial Sequence
  Synthetic oligonucleotide
ctggcacctggcattctggtgctgctg

SEQ ID NO: 2677 - DNA, 27 bp, Artificial Sequence
  Synthetic oligonucleotide
ggcacctggcattctggtgctgctgtt

SEQ ID NO: 2678 - DNA, 27 bp, Artificial Sequence
  Synthetic oligonucleotide
gcacctggcattctggtgctgctgttg

SEQ ID NO: 2679 - DNA, 27 bp, Artificial Sequence
  Synthetic oligonucleotide
ttctggtgctgctgttgtccttggtgc

SEQ ID NO: 2680 - DNA, 27 bp, Artificial Sequence
  Synthetic oligonucleotide
ctggtgctgctgttgtccttggtgcag

SEQ ID NO: 2681 - DNA, 27 bp, Artificial Sequence
  Synthetic oligonucleotide
tggtgctgctgttgtccttggtgcaga

SEQ ID NO: 2682 - DNA, 27 bp, Artificial Sequence
  Synthetic oligonucleotide
tgctgctgttgtccttggtgcagagga

SEQ ID NO: 2683 - DNA, 27 bp, Artificial Sequence
  Synthetic oligonucleotide
ctgttccgtagactctgggttgcactc

SEQ ID NO: 2684 - DNA, 27 bp, Artificial Sequence
  Synthetic oligonucleotide
gagcactgtttcaataggaccctgctg

SEQ ID NO: 2685 - DNA, 27 bp, Artificial Sequence
  Synthetic oligonucleotide
aaactcttccggctgtgaagcgcgcag

SEQ ID NO: 2686 - DNA, 27 bp, Artificial Sequence
  Synthetic oligonucleotide
actcttccggctgtgaagcgcgcagtg

SEQ ID NO: 2687 - DNA, 27 bp, Artificial Sequence
  Synthetic oligonucleotide
tttaccacggctttgcagcgcgtcgac

SEQ ID NO: 2688 - DNA, 27 bp, Artificial Sequence
  Synthetic oligonucleotide
taccacggctttgcagcgcgtcgactt

SEQ ID NO: 2689 - DNA, 27 bp, Artificial Sequence
  Synthetic oligonucleotide
cacggctttgcagcgcgtcgacttatt

SEQ ID NO: 2690 - DNA, 27 bp, Artificial Sequence
  Synthetic oligonucleotide
cggctttgcagcgcgtcgacttattca

SEQ ID NO: 2691 - DNA, 27 bp, Artificial Sequence
  Synthetic oligonucleotide
ggctttgcagcgcgtcgacttattcat

SEQ ID NO: 2692 - DNA, 27 bp, Artificial Sequence
  Synthetic oligonucleotide
gctttgcagcgcgtcgacttattcatg

SEQ ID NO: 2693 - DNA, 27 bp, Artificial Sequence
  Synthetic oligonucleotide
ctttgcagcgcgtcgacttattcatgg

SEQ ID NO: 2694 - DNA, 27 bp, Artificial Sequence
  Synthetic oligonucleotide
gcgcgtcgacttattcatgggccggct

SEQ ID NO: 2695 - DNA, 27 bp, Artificial Sequence
  Synthetic oligonucleotide
gtcgcttcatgcaggtggtgctctctc

SEQ ID NO: 2696 - DNA, 27 bp, Artificial Sequence
  Synthetic oligonucleotide
aggtggtgctctctcgaacagcacacc

SEQ ID NO: 2697 - DNA, 27 bp, Artificial Sequence
  Synthetic oligonucleotide
gtggtgctctctcgaacagcacacctc

SEQ ID NO: 2698 - DNA, 27 bp, Artificial Sequence
  Synthetic oligonucleotide
ctgcttggcaacgagagctgtaccttg

SEQ ID NO: 2699 - DNA, 27 bp, Artificial Sequence
  Synthetic oligonucleotide
tgcactactccttcactgaaacagctg

SEQ ID NO: 2700 - DNA, 27 bp, Artificial Sequence
  Synthetic oligonucleotide
agcaagcagtctcttcaactgttcttg

SEQ ID NO: 2701 - DNA, 27 bp, Artificial Sequence
  Synthetic oligonucleotide
gcaagcagtctcttcaactgttcttgg

SEQ ID NO: 2702 - DNA, 27 bp, Artificial Sequence
  Synthetic oligonucleotide
cagtctcttcaactgttcttggaaaag

SEQ ID NO: 2703 - DNA, 27 bp, Artificial Sequence
  Synthetic oligonucleotide
tcagcacgtagtgattggacccagcag

SEQ ID NO: 2704 - DNA, 27 bp, Artificial Sequence
  Synthetic oligonucleotide
tggacccagcagcctgattgtgcattt

SEQ ID NO: 2705 - DNA, 27 bp, Artificial Sequence
  Synthetic oligonucleotide
ctgtcaaggttgctgatttcggtcttg

SEQ ID NO: 2706 - DNA, 27 bp, Artificial Sequence
  Synthetic oligonucleotide
ggttgctgatttcggtcttgccagaga

SEQ ID NO: 2707 - DNA, 27 bp, Artificial Sequence
  Synthetic oligonucleotide
gtgccaagctaccagtaaagtggatgg

SEQ ID NO: 2708 - DNA, 27 bp, Artificial Sequence
  Synthetic oligonucleotide
caagctaccagtaaagtggatggcttt

SEQ ID NO: 2709 - DNA, 27 bp, Artificial Sequence
  Synthetic oligonucleotide
aagctaccagtaaagtggatggcttta

SEQ ID NO: 2710 - DNA, 27 bp, Artificial Sequence
  Synthetic oligonucleotide
ctttggtgtgctcctctgggagctcat

SEQ ID NO: 2711 - DNA, 27 bp, Artificial Sequence
  Synthetic oligonucleotide
tttggtgtgctcctctgggagctcatg

SEQ ID NO: 2712 - DNA, 27 bp, Artificial Sequence
  Synthetic oligonucleotide
tggtgtgctcctctgggagctcatgac

SEQ ID NO: 2713 - DNA, 27 bp, Artificial Sequence
  Synthetic oligonucleotide
ttttgttttgttttttgttttgctttt

SEQ ID NO: 2714 - DNA, 27 bp, Artificial Sequence
  Synthetic oligonucleotide
tttgttttgttttttgttttgcttttg

SEQ ID NO: 2715 - DNA, 27 bp, Artificial Sequence
  Synthetic oligonucleotide
ttgttttgttttttgttttgcttttgc

SEQ ID NO: 2716 - DNA, 27 bp, Artificial Sequence
  Synthetic oligonucleotide
tgttttgttttttgttttgcttttgcg

SEQ ID NO: 2717 - DNA, 27 bp, Artificial Sequence
  Synthetic oligonucleotide
gttttgttttttgttttgcttttgcgg

SEQ ID NO: 2718 - DNA, 27 bp, Artificial Sequence
  Synthetic oligonucleotide
tttgttttttgttttgcttttgcggta

SEQ ID NO: 2719 - DNA, 27 bp, Artificial Sequence
  Synthetic oligonucleotide
ttgttttttgttttgcttttgcggtaa

SEQ ID NO: 2720 - DNA, 27 bp, Artificial Sequence
  Synthetic oligonucleotide
tgttttttgttttgcttttgcggtaac

SEQ ID NO: 2721 - DNA, 27 bp, Artificial Sequence
  Synthetic oligonucleotide
gttttttgttttgcttttgcggtaact

SEQ ID NO: 2722 - DNA, 27 bp, Artificial Sequence
  Synthetic oligonucleotide
ttttttgttttgcttttgcggtaactg

SEQ ID NO: 2723 - DNA, 27 bp, Artificial Sequence
  Synthetic oligonucleotide
tttttgttttgcttttgcggtaactgc

SEQ ID NO: 2724 - DNA, 27 bp, Artificial Sequence
  Synthetic oligonucleotide
ttttgttttgcttttgcggtaactgca

SEQ ID NO: 2725 - DNA, 27 bp, Artificial Sequence
  Synthetic oligonucleotide
tttgttttgcttttgcggtaactgcac

SEQ ID NO: 2726 - DNA, 27 bp, Artificial Sequence
  Synthetic oligonucleotide
ttgttttgcttttgcggtaactgcacc

SEQ ID NO: 2727 - DNA, 27 bp, Artificial Sequence
  Synthetic oligonucleotide
tgttttgcttttgcggtaactgcacca

SEQ ID NO: 2728 - DNA, 27 bp, Artificial Sequence
  Synthetic oligonucleotide
gttttgcttttgcggtaactgcaccac

SEQ ID NO: 2729 - DNA, 27 bp, Artificial Sequence
  Synthetic oligonucleotide
ttttgcttttgcggtaactgcaccact

SEQ ID NO: 2730 - DNA, 27 bp, Artificial Sequence
  Synthetic oligonucleotide
tgcttttgcggtaactgcaccactatg

SEQ ID NO: 2731 - DNA, 27 bp, Artificial Sequence
  Synthetic oligonucleotide
aacccagctgtttagcaaggagtgttg

SEQ ID NO: 2732 - DNA, 27 bp, Artificial Sequence
  Synthetic oligonucleotide
cagctgtttagcaaggagtgttggctc

SEQ ID NO: 2733 - DNA, 27 bp, Artificial Sequence
  Synthetic oligonucleotide
ttttgtgcttactactgtatagtgcat

SEQ ID NO: 2734 - DNA, 27 bp, Artificial Sequence
  Synthetic oligonucleotide
tttgtgcttactactgtatagtgcatg

SEQ ID NO: 2735 - DNA, 27 bp, Artificial Sequence
  Synthetic oligonucleotide
ttgtgcttactactgtatagtgcatgt

SEQ ID NO: 2736 - DNA, 27 bp, Artificial Sequence
  Synthetic oligonucleotide
gtgcttactactgtatagtgcatgtgg

SEQ ID NO: 2737 - RNA, 25 nt, Artificial Sequence
  Synthetic oligonucleotide
gccucgccgcccgcagcguccgagc

SEQ ID NO: 2738 - RNA, 25 nt, Artificial Sequence
  Synthetic oligonucleotide
gugcggagccagaugcugggcgacc

SEQ ID NO: 2739 - RNA, 25 nt, Artificial Sequence
  Synthetic oligonucleotide
ggagccagaugcugggcgaccgcug

SEQ ID NO: 2740 - RNA, 25 nt, Artificial Sequence
  Synthetic oligonucleotide
augcugggcgaccgcugacucgcug

SEQ ID NO: 2741 - RNA, 25 nt, Artificial Sequence
  Synthetic oligonucleotide
ugcugggcgaccgcugacucgcugg

SEQ ID NO: 2742 - RNA, 25 nt, Artificial Sequence
  Synthetic oligonucleotide
cugggcgaccgcugacucgcuggag

SEQ ID NO: 2743 - RNA, 25 nt, Artificial Sequence
  Synthetic oligonucleotide
cagccggcugacuucggcgccgcgc

SEQ ID NO: 2744 - RNA, 25 nt, Artificial Sequence
  Synthetic oligonucleotide
gccggcugacuucggcgccgcgcgc

SEQ ID NO: 2745 - RNA, 25 nt, Artificial Sequence
  Synthetic oligonucleotide
cggcugacuucggcgccgcgcgcuc

SEQ ID NO: 2746 - RNA, 25 nt, Artificial Sequence
  Synthetic oligonucleotide
gcugacgguguagcagaacgcuugg

SEQ ID NO: 2747 - RNA, 25 nt, Artificial Sequence
  Synthetic oligonucleotide
cugacgguguagcagaacgcuuggc

SEQ ID NO: 2748 - RNA, 25 nt, Artificial Sequence
  Synthetic oligonucleotide
ggcaccuggcauucuggugcugcug

SEQ ID NO: 2749 - RNA, 25 nt, Artificial Sequence
  Synthetic oligonucleotide
caccuggcauucuggugcugcuguu

SEQ ID NO: 2750 - RNA, 25 nt, Artificial Sequence
  Synthetic oligonucleotide
accuggcauucuggugcugcuguug

SEQ ID NO: 2751 - RNA, 25 nt, Artificial Sequence
  Synthetic oligonucleotide
cuggugcugcuguuguccuuggugc

SEQ ID NO: 2752 - RNA, 25 nt, Artificial Sequence
  Synthetic oligonucleotide
ggugcugcuguuguccuuggugcag

SEQ ID NO: 2753 - RNA, 25 nt, Artificial Sequence
  Synthetic oligonucleotide
gugcugcuguuguccuuggugcaga

SEQ ID NO: 2754 - RNA, 25 nt, Artificial Sequence
  Synthetic oligonucleotide
cugcuguuguccuuggugcagagga

SEQ ID NO: 2755 - RNA, 25 nt, Artificial Sequence
  Synthetic oligonucleotide
guuccguagacucuggguugcacuc

SEQ ID NO: 2756 - RNA, 25 nt, Artificial Sequence
  Synthetic oligonucleotide
gcacuguuucaauaggacccugcug

SEQ ID NO: 2757 - RNA, 25 nt, Artificial Sequence
  Synthetic oligonucleotide
acucuuccggcugugaagcgcgcag

SEQ ID NO: 2758 - RNA, 25 nt, Artificial Sequence
  Synthetic oligonucleotide
ucuuccggcugugaagcgcgcagug

SEQ ID NO: 2759 - RNA, 25 nt, Artificial Sequence
  Synthetic oligonucleotide
uaccacggcuuugcagcgcgucgac

SEQ ID NO: 2760 - RNA, 25 nt, Artificial Sequence
  Synthetic oligonucleotide
ccacggcuuugcagcgcgucgacuu

SEQ ID NO: 2761 - RNA, 25 nt, Artificial Sequence
  Synthetic oligonucleotide
cggcuuugcagcgcgucgacuuauu

SEQ ID NO: 2762 - RNA, 25 nt, Artificial Sequence
  Synthetic oligonucleotide
gcuuugcagcgcgucgacuuauuca

SEQ ID NO: 2763 - RNA, 25 nt, Artificial Sequence
  Synthetic oligonucleotide
cuuugcagcgcgucgacuuauucau

SEQ ID NO: 2764 - RNA, 25 nt, Artificial Sequence
  Synthetic oligonucleotide
uuugcagcgcgucgacuuauucaug

SEQ ID NO: 2765 - RNA, 25 nt, Artificial Sequence
  Synthetic oligonucleotide
uugcagcgcgucgacuuauucaugg

SEQ ID NO: 2766 - RNA, 25 nt, Artificial Sequence
  Synthetic oligonucleotide
gcgucgacuuauucaugggccggcu

SEQ ID NO: 2767 - RNA, 25 nt, Artificial Sequence
  Synthetic oligonucleotide
cgcuucaugcagguggugcucucuc

SEQ ID NO: 2768 - RNA, 25 nt, Artificial Sequence
  Synthetic oligonucleotide
guggugcucucucgaacagcacacc

SEQ ID NO: 2769 - RNA, 25 nt, Artificial Sequence
  Synthetic oligonucleotide
ggugcucucucgaacagcacaccuc

SEQ ID NO: 2770 - RNA, 25 nt, Artificial Sequence
  Synthetic oligonucleotide
gcuuggcaacgagagcuguaccuug

SEQ ID NO: 2771 - RNA, 25 nt, Artificial Sequence
  Synthetic oligonucleotide
cacuacuccuucacugaaacagcug

SEQ ID NO: 2772 - RNA, 25 nt, Artificial Sequence
  Synthetic oligonucleotide
caagcagucucuucaacuguucuug

SEQ ID NO: 2773 - RNA, 25 nt, Artificial Sequence
  Synthetic oligonucleotide
aagcagucucuucaacuguucuugg

SEQ ID NO: 2774 - RNA, 25 nt, Artificial Sequence
  Synthetic oligonucleotide
gucucuucaacuguucuuggaaaag

SEQ ID NO: 2775 - RNA, 25 nt, Artificial Sequence
  Synthetic oligonucleotide
agcacguagugauuggacccagcag

SEQ ID NO: 2776 - RNA, 25 nt, Artificial Sequence
  Synthetic oligonucleotide
gacccagcagccugauugugcauuu

SEQ ID NO: 2777 - RNA, 25 nt, Artificial Sequence
  Synthetic oligonucleotide
gucaagguugcugauuucggucuug

SEQ ID NO: 2778 - RNA, 25 nt, Artificial Sequence
  Synthetic oligonucleotide
uugcugauuucggucuugccagaga

SEQ ID NO: 2779 - RNA, 25 nt, Artificial Sequence
  Synthetic oligonucleotide
gccaagcuaccaguaaaguggaugg

SEQ ID NO: 2780 - RNA, 25 nt, Artificial Sequence
  Synthetic oligonucleotide
agcuaccaguaaaguggauggcuuu

SEQ ID NO: 2781 - RNA, 25 nt, Artificial Sequence
  Synthetic oligonucleotide
gcuaccaguaaaguggauggcuuua

SEQ ID NO: 2782 - RNA, 25 nt, Artificial Sequence
  Synthetic oligonucleotide
uuggugugcuccucugggagcucau

SEQ ID NO: 2783 - RNA, 25 nt, Artificial Sequence
  Synthetic oligonucleotide
uggugugcuccucugggagcucaug

SEQ ID NO: 2784 - RNA, 25 nt, Artificial Sequence
  Synthetic oligonucleotide
gugugcuccucugggagcucaugac

SEQ ID NO: 2785 - RNA, 25 nt, Artificial Sequence
  Synthetic oligonucleotide
uuguuuuguuuuuuguuuugcuuuu

SEQ ID NO: 2786 - RNA, 25 nt, Artificial Sequence
  Synthetic oligonucleotide
uguuuuguuuuuuguuuugcuuuug

SEQ ID NO: 2787 - RNA, 25 nt, Artificial Sequence
  Synthetic oligonucleotide
guuuuguuuuuuguuuugcuuuugc

SEQ ID NO: 2788 - RNA, 25 nt, Artificial Sequence
  Synthetic oligonucleotide
uuuuguuuuuuguuuugcuuuugcg

SEQ ID NO: 2789 - RNA, 25 nt, Artificial Sequence
  Synthetic oligonucleotide
uuuguuuuuuguuuugcuuuugcgg

SEQ ID NO: 2790 - RNA, 25 nt, Artificial Sequence
  Synthetic oligonucleotide
uguuuuuuguuuugcuuuugcggua

SEQ ID NO: 2791 - RNA, 25 nt, Artificial Sequence
  Synthetic oligonucleotide
guuuuuuguuuugcuuuugcgguaa

SEQ ID NO: 2792 - RNA, 25 nt, Artificial Sequence
  Synthetic oligonucleotide
uuuuuuguuuugcuuuugcgguaac

SEQ ID NO: 2793 - RNA, 25 nt, Artificial Sequence
  Synthetic oligonucleotide
uuuuuguuuugcuuuugcgguaacu

SEQ ID NO: 2794 - RNA, 25 nt, Artificial Sequence
  Synthetic oligonucleotide
uuuuguuuugcuuuugcgguaacug

SEQ ID NO: 2795 - RNA, 25 nt, Artificial Sequence
  Synthetic oligonucleotide
uuuguuuugcuuuugcgguaacugc

SEQ ID NO: 2796 - RNA, 25 nt, Artificial Sequence
  Synthetic oligonucleotide
uuguuuugcuuuugcgguaacugca

SEQ ID NO: 2797 - RNA, 25 nt, Artificial Sequence
  Synthetic oligonucleotide
uguuuugcuuuugcgguaacugcac

SEQ ID NO: 2798 - RNA, 25 nt, Artificial Sequence
  Synthetic oligonucleotide
guuuugcuuuugcgguaacugcacc

SEQ ID NO: 2799 - RNA, 25 nt, Artificial Sequence
  Synthetic oligonucleotide
uuuugcuuuugcgguaacugcacca

SEQ ID NO: 2800 - RNA, 25 nt, Artificial Sequence
  Synthetic oligonucleotide
uuugcuuuugcgguaacugcaccac

SEQ ID NO: 2801 - RNA, 25 nt, Artificial Sequence
  Synthetic oligonucleotide
uugcuuuugcgguaacugcaccacu

SEQ ID NO: 2802 - RNA, 25 nt, Artificial Sequence
  Synthetic oligonucleotide
cuuuugcgguaacugcaccacuaug

SEQ ID NO: 2803 - RNA, 25 nt, Artificial Sequence
  Synthetic oligonucleotide
cccagcuguuuagcaaggaguguug

SEQ ID NO: 2804 - RNA, 25 nt, Artificial Sequence
  Synthetic oligonucleotide
gcuguuuagcaaggaguguuggcuc

SEQ ID NO: 2805 - RNA, 25 nt, Artificial Sequence
  Synthetic oligonucleotide
uugugcuuacuacuguauagugcau

SEQ ID NO: 2806 - RNA, 25 nt, Artificial Sequence
  Synthetic oligonucleotide
ugugcuuacuacuguauagugcaug

SEQ ID NO: 2807 - RNA, 25 nt, Artificial Sequence
  Synthetic oligonucleotide
gugcuuacuacuguauagugcaugu

SEQ ID NO: 2808 - RNA, 25 nt, Artificial Sequence
  Synthetic oligonucleotide
gcuuacuacuguauagugcaugugg

SEQ ID NO: 2809 - RNA, 21 nt, Artificial Sequence
  Synthetic oligonucleotide
cggccucgccgcccgcagcgu

SEQ ID NO: 2810 - RNA, 21 nt, Artificial Sequence
  Synthetic oligonucleotide
cugugcggagccagaugcugg

SEQ ID NO: 2811 - RNA, 21 nt, Artificial Sequence
  Synthetic oligonucleotide
gcggagccagaugcugggcga

SEQ ID NO: 2812 - RNA, 21 nt, Artificial Sequence
  Synthetic oligonucleotide
agaugcugggcgaccgcugac

SEQ ID NO: 2813 - RNA, 21 nt, Artificial Sequence
  Synthetic oligonucleotide
gaugcugggcgaccgcugacu

SEQ ID NO: 2814 - RNA, 21 nt, Artificial Sequence
  Synthetic oligonucleotide
ugcugggcgaccgcugacucg

SEQ ID NO: 2815 - RNA, 21 nt, Artificial Sequence
  Synthetic oligonucleotide
cccagccggcugacuucggcg

SEQ ID NO: 2816 - RNA, 21 nt, Artificial Sequence
  Synthetic oligonucleotide
cagccggcugacuucggcgcc

SEQ ID NO: 2817 - RNA, 21 nt, Artificial Sequence
  Synthetic oligonucleotide
gccggcugacuucggcgccgc

SEQ ID NO: 2818 - RNA, 21 nt, Artificial Sequence
  Synthetic oligonucleotide
aagcugacgguguagcagaac

SEQ ID NO: 2819 - RNA, 21 nt, Artificial Sequence
  Synthetic oligonucleotide
agcugacgguguagcagaacg

SEQ ID NO: 2820 - RNA, 21 nt, Artificial Sequence
  Synthetic oligonucleotide
cuggcaccuggcauucuggug

SEQ ID NO: 2821 - RNA, 21 nt, Artificial Sequence
  Synthetic oligonucleotide
ggcaccuggcauucuggugcu

SEQ ID NO: 2822 - RNA, 21 nt, Artificial Sequence
  Synthetic oligonucleotide
gcaccuggcauucuggugcug

SEQ ID NO: 2823 - RNA, 21 nt, Artificial Sequence
  Synthetic oligonucleotide
uucuggugcugcuguuguccu

SEQ ID NO: 2824 - RNA, 21 nt, Artificial Sequence
  Synthetic oligonucleotide
cuggugcugcuguuguccuug

SEQ ID NO: 2825 - RNA, 21 nt, Artificial Sequence
  Synthetic oligonucleotide
uggugcugcuguuguccuugg

SEQ ID NO: 2826 - RNA, 21 nt, Artificial Sequence
  Synthetic oligonucleotide
ugcugcuguuguccuuggugc

SEQ ID NO: 2827 - RNA, 21 nt, Artificial Sequence
  Synthetic oligonucleotide
cuguuccguagacucuggguu

SEQ ID NO: 2828 - RNA, 21 nt, Artificial Sequence
  Synthetic oligonucleotide
gagcacuguuucaauaggacc

SEQ ID NO: 2829 - RNA, 21 nt, Artificial Sequence
  Synthetic oligonucleotide
aaacucuuccggcugugaagc

SEQ ID NO: 2830 - RNA, 21 nt, Artificial Sequence
  Synthetic oligonucleotide
acucuuccggcugugaagcgc

SEQ ID NO: 2831 - RNA, 21 nt, Artificial Sequence
  Synthetic oligonucleotide
uuuaccacggcuuugcagcgc

SEQ ID NO: 2832 - RNA, 21 nt, Artificial Sequence
  Synthetic oligonucleotide
uaccacggcuuugcagcgcgu

SEQ ID NO: 2833 - RNA, 21 nt, Artificial Sequence
  Synthetic oligonucleotide
cacggcuuugcagcgcgucga

SEQ ID NO: 2834 - RNA, 21 nt, Artificial Sequence
  Synthetic oligonucleotide
cggcuuugcagcgcgucgacu

SEQ ID NO: 2835 - RNA, 21 nt, Artificial Sequence
  Synthetic oligonucleotide
ggcuuugcagcgcgucgacuu

SEQ ID NO: 2836 - RNA, 21 nt, Artificial Sequence
  Synthetic oligonucleotide
gcuuugcagcgcgucgacuua

SEQ ID NO: 2837 - RNA, 21 nt, Artificial Sequence
  Synthetic oligonucleotide
cuuugcagcgcgucgacuuau

SEQ ID NO: 2838 - RNA, 21 nt, Artificial Sequence
  Synthetic oligonucleotide
gcgcgucgacuuauucauggg

SEQ ID NO: 2839 - RNA, 21 nt, Artificial Sequence
  Synthetic oligonucleotide
gucgcuucaugcagguggugc

SEQ ID NO: 2840 - RNA, 21 nt, Artificial Sequence
  Synthetic oligonucleotide
agguggugcucucucgaacag

SEQ ID NO: 2841 - RNA, 21 nt, Artificial Sequence
  Synthetic oligonucleotide
guggugcucucucgaacagca

SEQ ID NO: 2842 - RNA, 21 nt, Artificial Sequence
  Synthetic oligonucleotide
cugcuuggcaacgagagcugu

SEQ ID NO: 2843 - RNA, 21 nt, Artificial Sequence
  Synthetic oligonucleotide
ugcacuacuccuucacugaaa

SEQ ID NO: 2844 - RNA, 21 nt, Artificial Sequence
  Synthetic oligonucleotide
agcaagcagucucuucaacug

SEQ ID NO: 2845 - RNA, 21 nt, Artificial Sequence
  Synthetic oligonucleotide
gcaagcagucucuucaacugu

SEQ ID NO: 2846 - RNA, 21 nt, Artificial Sequence
  Synthetic oligonucleotide
cagucucuucaacuguucuug

SEQ ID NO: 2847 - RNA, 21 nt, Artificial Sequence
  Synthetic oligonucleotide
ucagcacguagugauuggacc

SEQ ID NO: 2848 - RNA, 21 nt, Artificial Sequence
  Synthetic oligonucleotide
uggacccagcagccugauugu

SEQ ID NO: 2849 - RNA, 21 nt, Artificial Sequence
  Synthetic oligonucleotide
cugucaagguugcugauuucg

SEQ ID NO: 2850 - RNA, 21 nt, Artificial Sequence
  Synthetic oligonucleotide
gguugcugauuucggucuugc

SEQ ID NO: 2851 - RNA, 21 nt, Artificial Sequence
  Synthetic oligonucleotide
gugccaagcuaccaguaaagu

SEQ ID NO: 2852 - RNA, 21 nt, Artificial Sequence
  Synthetic oligonucleotide
caagcuaccaguaaaguggau

SEQ ID NO: 2853 - RNA, 21 nt, Artificial Sequence
  Synthetic oligonucleotide
aagcuaccaguaaaguggaug

SEQ ID NO: 2854 - RNA, 21 nt, Artificial Sequence
  Synthetic oligonucleotide
cuuuggugugcuccucuggga

SEQ ID NO: 2855 - RNA, 21 nt, Artificial Sequence
  Synthetic oligonucleotide
uuuggugugcuccucugggag

SEQ ID NO: 2856 - RNA, 21 nt, Artificial Sequence
  Synthetic oligonucleotide
uggugugcuccucugggagcu

SEQ ID NO: 2857 - RNA, 21 nt, Artificial Sequence
  Synthetic oligonucleotide
uuuuguuuuguuuuuuguuuu

SEQ ID NO: 2858 - RNA, 21 nt, Artificial Sequence
  Synthetic oligonucleotide
uuuguuuuguuuuuuguuuug

SEQ ID NO: 2859 - RNA, 21 nt, Artificial Sequence
  Synthetic oligonucleotide
uuguuuuguuuuuuguuuugc

SEQ ID NO: 2860 - RNA, 21 nt, Artificial Sequence
  Synthetic oligonucleotide
uguuuuguuuuuuguuuugcu

SEQ ID NO: 2861 - RNA, 21 nt, Artificial Sequence
  Synthetic oligonucleotide
guuuuguuuuuuguuuugcuu

SEQ ID NO: 2862 - RNA, 21 nt, Artificial Sequence
  Synthetic oligonucleotide
uuuguuuuuuguuuugcuuuu

SEQ ID NO: 2863 - RNA, 21 nt, Artificial Sequence
  Synthetic oligonucleotide
uuguuuuuuguuuugcuuuug

SEQ ID NO: 2864 - RNA, 21 nt, Artificial Sequence
  Synthetic oligonucleotide
uguuuuuuguuuugcuuuugc

SEQ ID NO: 2865 - RNA, 21 nt, Artificial Sequence
  Synthetic oligonucleotide
guuuuuuguuuugcuuuugcg

SEQ ID NO: 2866 - RNA, 21 nt, Artificial Sequence
  Synthetic oligonucleotide
uuuuuuguuuugcuuuugcgg

SEQ ID NO: 2867 - RNA, 21 nt, Artificial Sequence
  Synthetic oligonucleotide
uuuuuguuuugcuuuugcggu

SEQ ID NO: 2868 - RNA, 21 nt, Artificial Sequence
  Synthetic oligonucleotide
uuuuguuuugcuuuugcggua

SEQ ID NO: 2869 - RNA, 21 nt, Artificial Sequence
  Synthetic oligonucleotide
uuuguuuugcuuuugcgguaa

SEQ ID NO: 2870 - RNA, 21 nt, Artificial Sequence
  Synthetic oligonucleotide
uuguuuugcuuuugcgguaac

SEQ ID NO: 2871 - RNA, 21 nt, Artificial Sequence
  Synthetic oligonucleotide
uguuuugcuuuugcgguaacu

SEQ ID NO: 2872 - RNA, 21 nt, Artificial Sequence
  Synthetic oligonucleotide
guuuugcuuuugcgguaacug

SEQ ID NO: 2873 - RNA, 21 nt, Artificial Sequence
  Synthetic oligonucleotide
uuuugcuuuugcgguaacugc

SEQ ID NO: 2874 - RNA, 21 nt, Artificial Sequence
  Synthetic oligonucleotide
ugcuuuugcgguaacugcacc

SEQ ID NO: 2875 - RNA, 21 nt, Artificial Sequence
  Synthetic oligonucleotide
aacccagcuguuuagcaagga

SEQ ID NO: 2876 - RNA, 21 nt, Artificial Sequence
  Synthetic oligonucleotide
cagcuguuuagcaaggagugu

SEQ ID NO: 2877 - RNA, 21 nt, Artificial Sequence
  Synthetic oligonucleotide
uuuugugcuuacuacuguaua

SEQ ID NO: 2878 - RNA, 21 nt, Artificial Sequence
  Synthetic oligonucleotide
uuugugcuuacuacuguauag

SEQ ID NO: 2879 - RNA, 21 nt, Artificial Sequence
  Synthetic oligonucleotide
uugugcuuacuacuguauagu

SEQ ID NO: 2880 - RNA, 21 nt, Artificial Sequence
  Synthetic oligonucleotide
gugcuuacuacuguauagugc

SEQ ID NO: 2881 - RNA, 27 nt, Artificial Sequence
  Synthetic oligonucleotide
cggccucgccgcccgcagcguccgaaa

SEQ ID NO: 2882 - RNA, 27 nt, Artificial Sequence
  Synthetic oligonucleotide
cugugcggagccagaugcugggcgaaa

SEQ ID NO: 2883 - RNA, 27 nt, Artificial Sequence
  Synthetic oligonucleotide
gcggagccagaugcugggcgaccgcca

SEQ ID NO: 2884 - RNA, 27 nt, Artificial Sequence
  Synthetic oligonucleotide
agaugcugggcgaccgcugacucgcca

SEQ ID NO: 2885 - RNA, 27 nt, Artificial Sequence
  Synthetic oligonucleotide
gaugcugggcgaccgcugacucgcuaa

SEQ ID NO: 2886 - RNA, 27 nt, Artificial Sequence
  Synthetic oligonucleotide
ugcugggcgaccgcugacucgcuggca

SEQ ID NO: 2887 - RNA, 27 nt, Artificial Sequence
  Synthetic oligonucleotide
cccagccggcugacuucggcgccgcaa

SEQ ID NO: 2888 - RNA, 27 nt, Artificial Sequence
  Synthetic oligonucleotide
cagccggcugacuucggcgccgcgcaa

SEQ ID NO: 2889 - RNA, 27 nt, Artificial Sequence
  Synthetic oligonucleotide
gccggcugacuucggcgccgcgcgcca

SEQ ID NO: 2890 - RNA, 27 nt, Artificial Sequence
  Synthetic oligonucleotide
aagcugacgguguagcagaacgcuuaa

SEQ ID NO: 2891 - RNA, 27 nt, Artificial Sequence
  Synthetic oligonucleotide
agcugacgguguagcagaacgcuugaa

SEQ ID NO: 2892 - RNA, 27 nt, Artificial Sequence
  Synthetic oligonucleotide
cuggcaccuggcauucuggugcugcca

SEQ ID NO: 2893 - RNA, 27 nt, Artificial Sequence
  Synthetic oligonucleotide
ggcaccuggcauucuggugcugcugcc

SEQ ID NO: 2894 - RNA, 27 nt, Artificial Sequence
  Synthetic oligonucleotide
gcaccuggcauucuggugcugcuguca

SEQ ID NO: 2895 - RNA, 27 nt, Artificial Sequence
  Synthetic oligonucleotide
uucuggugcugcuguuguccuugguaa

SEQ ID NO: 2896 - RNA, 27 nt, Artificial Sequence
  Synthetic oligonucleotide
cuggugcugcuguuguccuuggugcca

SEQ ID NO: 2897 - RNA, 27 nt, Artificial Sequence
  Synthetic oligonucleotide
uggugcugcuguuguccuuggugcaac

SEQ ID NO: 2898 - RNA, 27 nt, Artificial Sequence
  Synthetic oligonucleotide
ugcugcuguuguccuuggugcagagac

SEQ ID NO: 2899 - RNA, 27 nt, Artificial Sequence
  Synthetic oligonucleotide
cuguuccguagacucuggguugcacca

SEQ ID NO: 2900 - RNA, 27 nt, Artificial Sequence
  Synthetic oligonucleotide
gagcacuguuucaauaggacccugcca

SEQ ID NO: 2901 - RNA, 27 nt, Artificial Sequence
  Synthetic oligonucleotide
aaacucuuccggcugugaagcgcgcca

SEQ ID NO: 2902 - RNA, 27 nt, Artificial Sequence
  Synthetic oligonucleotide
acucuuccggcugugaagcgcgcagca

SEQ ID NO: 2903 - RNA, 27 nt, Artificial Sequence
  Synthetic oligonucleotide
uuuaccacggcuuugcagcgcgucgca

SEQ ID NO: 2904 - RNA, 27 nt, Artificial Sequence
  Synthetic oligonucleotide
uaccacggcuuugcagcgcgucgaccc

SEQ ID NO: 2905 - RNA, 27 nt, Artificial Sequence
  Synthetic oligonucleotide
cacggcuuugcagcgcgucgacuuacc

SEQ ID NO: 2906 - RNA, 27 nt, Artificial Sequence
  Synthetic oligonucleotide
cggcuuugcagcgcgucgacuuauuac

SEQ ID NO: 2907 - RNA, 27 nt, Artificial Sequence
  Synthetic oligonucleotide
ggcuuugcagcgcgucgacuuauuccc

SEQ ID NO: 2908 - RNA, 27 nt, Artificial Sequence
  Synthetic oligonucleotide
gcuuugcagcgcgucgacuuauucaca

SEQ ID NO: 2909 - RNA, 27 nt, Artificial Sequence
  Synthetic oligonucleotide
cuuugcagcgcgucgacuuauucauaa

SEQ ID NO: 2910 - RNA, 27 nt, Artificial Sequence
  Synthetic oligonucleotide
gcgcgucgacuuauucaugggccggac

SEQ ID NO: 2911 - RNA, 27 nt, Artificial Sequence
  Synthetic oligonucleotide
gucgcuucaugcagguggugcucucca

SEQ ID NO: 2912 - RNA, 27 nt, Artificial Sequence
  Synthetic oligonucleotide
agguggugcucucucgaacagcacaaa

SEQ ID NO: 2913 - RNA, 27 nt, Artificial Sequence
  Synthetic oligonucleotide
guggugcucucucgaacagcacaccca

SEQ ID NO: 2914 - RNA, 27 nt, Artificial Sequence
  Synthetic oligonucleotide
cugcuuggcaacgagagcuguaccuca

SEQ ID NO: 2915 - RNA, 27 nt, Artificial Sequence
  Synthetic oligonucleotide
ugcacuacuccuucacugaaacagcca

SEQ ID NO: 2916 - RNA, 27 nt, Artificial Sequence
  Synthetic oligonucleotide
agcaagcagucucuucaacuguucuca

SEQ ID NO: 2917 - RNA, 27 nt, Artificial Sequence
  Synthetic oligonucleotide
gcaagcagucucuucaacuguucuuaa

SEQ ID NO: 2918 - RNA, 27 nt, Artificial Sequence
  Synthetic oligonucleotide
cagucucuucaacuguucuuggaaaca

SEQ ID NO: 2919 - RNA, 27 nt, Artificial Sequence
  Synthetic oligonucleotide
ucagcacguagugauuggacccagcca

SEQ ID NO: 2920 - RNA, 27 nt, Artificial Sequence
  Synthetic oligonucleotide
uggacccagcagccugauugugcaucc

SEQ ID NO: 2921 - RNA, 27 nt, Artificial Sequence
  Synthetic oligonucleotide
cugucaagguugcugauuucggucuca

SEQ ID NO: 2922 - RNA, 27 nt, Artificial Sequence
  Synthetic oligonucleotide
gguugcugauuucggucuugccagaac

SEQ ID NO: 2923 - RNA, 27 nt, Artificial Sequence
  Synthetic oligonucleotide
gugccaagcuaccaguaaaguggauaa

SEQ ID NO: 2924 - RNA, 27 nt, Artificial Sequence
  Synthetic oligonucleotide
caagcuaccaguaaaguggauggcucc

SEQ ID NO: 2925 - RNA, 27 nt, Artificial Sequence
  Synthetic oligonucleotide
aagcuaccaguaaaguggauggcuucc

SEQ ID NO: 2926 - RNA, 27 nt, Artificial Sequence
  Synthetic oligonucleotide
cuuuggugugcuccucugggagcuccc

SEQ ID NO: 2927 - RNA, 27 nt, Artificial Sequence
  Synthetic oligonucleotide
uuuggugugcuccucugggagcucaca

SEQ ID NO: 2928 - RNA, 27 nt, Artificial Sequence
  Synthetic oligonucleotide
uggugugcuccucugggagcucaugca

SEQ ID NO: 2929 - RNA, 27 nt, Artificial Sequence
  Synthetic oligonucleotide
uuuuguuuuguuuuuuguuuugcuucc

SEQ ID NO: 2930 - RNA, 27 nt, Artificial Sequence
  Synthetic oligonucleotide
uuuguuuuguuuuuuguuuugcuuuca

SEQ ID NO: 2931 - RNA, 27 nt, Artificial Sequence
  Synthetic oligonucleotide
uuguuuuguuuuuuguuuugcuuuuaa

SEQ ID NO: 2932 - RNA, 27 nt, Artificial Sequence
  Synthetic oligonucleotide
uguuuuguuuuuuguuuugcuuuugaa

SEQ ID NO: 2933 - RNA, 27 nt, Artificial Sequence
  Synthetic oligonucleotide
guuuuguuuuuuguuuugcuuuugcaa

SEQ ID NO: 2934 - RNA, 27 nt, Artificial Sequence
  Synthetic oligonucleotide
uuuguuuuuuguuuugcuuuugcggcc

SEQ ID NO: 2935 - RNA, 27 nt, Artificial Sequence
  Synthetic oligonucleotide
uuguuuuuuguuuugcuuuugcggucc

SEQ ID NO: 2936 - RNA, 27 nt, Artificial Sequence
  Synthetic oligonucleotide
uguuuuuuguuuugcuuuugcgguaca

SEQ ID NO: 2937 - RNA, 27 nt, Artificial Sequence
  Synthetic oligonucleotide
guuuuuuguuuugcuuuugcgguaaac

SEQ ID NO: 2938 - RNA, 27 nt, Artificial Sequence
  Synthetic oligonucleotide
uuuuuuguuuugcuuuugcgguaacca

SEQ ID NO: 2939 - RNA, 27 nt, Artificial Sequence
  Synthetic oligonucleotide
uuuuuguuuugcuuuugcgguaacuaa

SEQ ID NO: 2940 - RNA, 27 nt, Artificial Sequence
  Synthetic oligonucleotide
uuuuguuuugcuuuugcgguaacugac

SEQ ID NO: 2941 - RNA, 27 nt, Artificial Sequence
  Synthetic oligonucleotide
uuuguuuugcuuuugcgguaacugcca

SEQ ID NO: 2942 - RNA, 27 nt, Artificial Sequence
  Synthetic oligonucleotide
uuguuuugcuuuugcgguaacugcaaa

SEQ ID NO: 2943 - RNA, 27 nt, Artificial Sequence
  Synthetic oligonucleotide
uguuuugcuuuugcgguaacugcacac

SEQ ID NO: 2944 - RNA, 27 nt, Artificial Sequence
  Synthetic oligonucleotide
guuuugcuuuugcgguaacugcaccca

SEQ ID NO: 2945 - RNA, 27 nt, Artificial Sequence
  Synthetic oligonucleotide
uuuugcuuuugcgguaacugcaccaac

SEQ ID NO: 2946 - RNA, 27 nt, Artificial Sequence
  Synthetic oligonucleotide
ugcuuuugcgguaacugcaccacuaca

SEQ ID NO: 2947 - RNA, 27 nt, Artificial Sequence
  Synthetic oligonucleotide
aacccagcuguuuagcaaggaguguca

SEQ ID NO: 2948 - RNA, 27 nt, Artificial Sequence
  Synthetic oligonucleotide
cagcuguuuagcaaggaguguuggcca

SEQ ID NO: 2949 - RNA, 27 nt, Artificial Sequence
  Synthetic oligonucleotide
uuuugugcuuacuacuguauagugccc

SEQ ID NO: 2950 - RNA, 27 nt, Artificial Sequence
  Synthetic oligonucleotide
uuugugcuuacuacuguauagugcaca

SEQ ID NO: 2951 - RNA, 27 nt, Artificial Sequence
  Synthetic oligonucleotide
uugugcuuacuacuguauagugcauac

SEQ ID NO: 2952 - RNA, 27 nt, Artificial Sequence
  Synthetic oligonucleotide
gugcuuacuacuguauagugcauguaa

SEQ ID NO: 2953 - RNA, 27 nt, Artificial Sequence
  Synthetic oligonucleotide
cggccucgccgcccgcagcguccgagc

SEQ ID NO: 2954 - RNA, 27 nt, Artificial Sequence
  Synthetic oligonucleotide
cugugcggagccagaugcugggcgacc

SEQ ID NO: 2955 - RNA, 27 nt, Artificial Sequence
  Synthetic oligonucleotide
gcggagccagaugcugggcgaccgcug

SEQ ID NO: 2956 - RNA, 27 nt, Artificial Sequence
  Synthetic oligonucleotide
agaugcugggcgaccgcugacucgcug

SEQ ID NO: 2957 - RNA, 27 nt, Artificial Sequence
  Synthetic oligonucleotide
gaugcugggcgaccgcugacucgcugg

SEQ ID NO: 2958 - RNA, 27 nt, Artificial Sequence
  Synthetic oligonucleotide
ugcugggcgaccgcugacucgcuggag

SEQ ID NO: 2959 - RNA, 27 nt, Artificial Sequence
  Synthetic oligonucleotide
cccagccggcugacuucggcgccgcgc

SEQ ID NO: 2960 - RNA, 27 nt, Artificial Sequence
  Synthetic oligonucleotide
cagccggcugacuucggcgccgcgcgc

SEQ ID NO: 2961 - RNA, 27 nt, Artificial Sequence
  Synthetic oligonucleotide
gccggcugacuucggcgccgcgcgcuc

SEQ ID NO: 2962 - RNA, 27 nt, Artificial Sequence
  Synthetic oligonucleotide
aagcugacgguguagcagaacgcuugg

SEQ ID NO: 2963 - RNA, 27 nt, Artificial Sequence
  Synthetic oligonucleotide
agcugacgguguagcagaacgcuuggc

SEQ ID NO: 2964 - RNA, 27 nt, Artificial Sequence
  Synthetic oligonucleotide
cuggcaccuggcauucuggugcugcug

SEQ ID NO: 2965 - RNA, 27 nt, Artificial Sequence
  Synthetic oligonucleotide
ggcaccuggcauucuggugcugcuguu

SEQ ID NO: 2966 - RNA, 27 nt, Artificial Sequence
  Synthetic oligonucleotide
gcaccuggcauucuggugcugcuguug

SEQ ID NO: 2967 - RNA, 27 nt, Artificial Sequence
  Synthetic oligonucleotide
uucuggugcugcuguuguccuuggugc

SEQ ID NO: 2968 - RNA, 27 nt, Artificial Sequence
  Synthetic oligonucleotide
cuggugcugcuguuguccuuggugcag

SEQ ID NO: 2969 - RNA, 27 nt, Artificial Sequence
  Synthetic oligonucleotide
uggugcugcuguuguccuuggugcaga

SEQ ID NO: 2970 - RNA, 27 nt, Artificial Sequence
  Synthetic oligonucleotide
ugcugcuguuguccuuggugcagagga

SEQ ID NO: 2971 - RNA, 27 nt, Artificial Sequence
  Synthetic oligonucleotide
cuguuccguagacucuggguugcacuc

SEQ ID NO: 2972 - RNA, 27 nt, Artificial Sequence
  Synthetic oligonucleotide
gagcacuguuucaauaggacccugcug

SEQ ID NO: 2973 - RNA, 27 nt, Artificial Sequence
  Synthetic oligonucleotide
aaacucuuccggcugugaagcgcgcag

SEQ ID NO: 2974 - RNA, 27 nt, Artificial Sequence
  Synthetic oligonucleotide
acucuuccggcugugaagcgcgcagug

SEQ ID NO: 2975 - RNA, 27 nt, Artificial Sequence
  Synthetic oligonucleotide
uuuaccacggcuuugcagcgcgucgac

SEQ ID NO: 2976 - RNA, 27 nt, Artificial Sequence
  Synthetic oligonucleotide
uaccacggcuuugcagcgcgucgacuu

SEQ ID NO: 2977 - RNA, 27 nt, Artificial Sequence
  Synthetic oligonucleotide
cacggcuuugcagcgcgucgacuuauu

SEQ ID NO: 2978 - RNA, 27 nt, Artificial Sequence
  Synthetic oligonucleotide
cggcuuugcagcgcgucgacuuauuca

SEQ ID NO: 2979 - RNA, 27 nt, Artificial Sequence
  Synthetic oligonucleotide
ggcuuugcagcgcgucgacuuauucau

SEQ ID NO: 2980 - RNA, 27 nt, Artificial Sequence
  Synthetic oligonucleotide
gcuuugcagcgcgucgacuuauucaug

SEQ ID NO: 2981 - RNA, 27 nt, Artificial Sequence
  Synthetic oligonucleotide
cuuugcagcgcgucgacuuauucaugg

SEQ ID NO: 2982 - RNA, 27 nt, Artificial Sequence
  Synthetic oligonucleotide
gcgcgucgacuuauucaugggccggcu

SEQ ID NO: 2983 - RNA, 27 nt, Artificial Sequence
  Synthetic oligonucleotide
gucgcuucaugcagguggugcucucuc

SEQ ID NO: 2984 - RNA, 27 nt, Artificial Sequence
  Synthetic oligonucleotide
agguggugcucucucgaacagcacacc

SEQ ID NO: 2985 - RNA, 27 nt, Artificial Sequence
  Synthetic oligonucleotide
guggugcucucucgaacagcacaccuc

SEQ ID NO: 2986 - RNA, 27 nt, Artificial Sequence
  Synthetic oligonucleotide
cugcuuggcaacgagagcuguaccuug

SEQ ID NO: 2987 - RNA, 27 nt, Artificial Sequence
  Synthetic oligonucleotide
ugcacuacuccuucacugaaacagcug

SEQ ID NO: 2988 - RNA, 27 nt, Artificial Sequence
  Synthetic oligonucleotide
agcaagcagucucuucaacuguucuug

SEQ ID NO: 2989 - RNA, 27 nt, Artificial Sequence
  Synthetic oligonucleotide
gcaagcagucucuucaacuguucuugg

SEQ ID NO: 2990 - RNA, 27 nt, Artificial Sequence
  Synthetic oligonucleotide
cagucucuucaacuguucuuggaaaag

SEQ ID NO: 2991 - RNA, 27 nt, Artificial Sequence
  Synthetic oligonucleotide
ucagcacguagugauuggacccagcag

SEQ ID NO: 2992 - RNA, 27 nt, Artificial Sequence
  Synthetic oligonucleotide
uggacccagcagccugauugugcauuu

SEQ ID NO: 2993 - RNA, 27 nt, Artificial Sequence
  Synthetic oligonucleotide
cugucaagguugcugauuucggucuug

SEQ ID NO: 2994 - RNA, 27 nt, Artificial Sequence
  Synthetic oligonucleotide
gguugcugauuucggucuugccagaga

SEQ ID NO: 2995 - RNA, 27 nt, Artificial Sequence
  Synthetic oligonucleotide
gugccaagcuaccaguaaaguggaugg

SEQ ID NO: 2996 - RNA, 27 nt, Artificial Sequence
  Synthetic oligonucleotide
caagcuaccaguaaaguggauggcuuu

SEQ ID NO: 2997 - RNA, 27 nt, Artificial Sequence
  Synthetic oligonucleotide
aagcuaccaguaaaguggauggcuuua

SEQ ID NO: 2998 - RNA, 27 nt, Artificial Sequence
  Synthetic oligonucleotide
cuuuggugugcuccucugggagcucau

SEQ ID NO: 2999 - RNA, 27 nt, Artificial Sequence
  Synthetic oligonucleotide
uuuggugugcuccucugggagcucaug

SEQ ID NO: 3000 - RNA, 27 nt, Artificial Sequence
  Synthetic oligonucleotide
uggugugcuccucugggagcucaugac

SEQ ID NO: 3001 - RNA, 27 nt, Artificial Sequence
  Synthetic oligonucleotide
uuuuguuuuguuuuuuguuuugcuuuu

SEQ ID NO: 3002 - RNA, 27 nt, Artificial Sequence
  Synthetic oligonucleotide
uuuguuuuguuuuuuguuuugcuuuug

SEQ ID NO: 3003 - RNA, 27 nt, Artificial Sequence
  Synthetic oligonucleotide
uuguuuuguuuuuuguuuugcuuuugc

SEQ ID NO: 3004 - RNA, 27 nt, Artificial Sequence
  Synthetic oligonucleotide
uguuuuguuuuuuguuuugcuuuugcg

SEQ ID NO: 3005 - RNA, 27 nt, Artificial Sequence
  Synthetic oligonucleotide
guuuuguuuuuuguuuugcuuuugcgg

SEQ ID NO: 3006 - RNA, 27 nt, Artificial Sequence
  Synthetic oligonucleotide
uuuguuuuuuguuuugcuuuugcggua

SEQ ID NO: 3007 - RNA, 27 nt, Artificial Sequence
  Synthetic oligonucleotide
uuguuuuuuguuuugcuuuugcgguaa

SEQ ID NO: 3008 - RNA, 27 nt, Artificial Sequence
  Synthetic oligonucleotide
uguuuuuuguuuugcuuuugcgguaac

SEQ ID NO: 3009 - RNA, 27 nt, Artificial Sequence
  Synthetic oligonucleotide
guuuuuuguuuugcuuuugcgguaacu

SEQ ID NO: 3010 - RNA, 27 nt, Artificial Sequence
  Synthetic oligonucleotide
uuuuuuguuuugcuuuugcgguaacug

SEQ ID NO: 3011 - RNA, 27 nt, Artificial Sequence
  Synthetic oligonucleotide
uuuuuguuuugcuuuugcgguaacugc

SEQ ID NO: 3012 - RNA, 27 nt, Artificial Sequence
  Synthetic oligonucleotide
uuuuguuuugcuuuugcgguaacugca

SEQ ID NO: 3013 - RNA, 27 nt, Artificial Sequence
  Synthetic oligonucleotide
uuuguuuugcuuuugcgguaacugcac

SEQ ID NO: 3014 - RNA, 27 nt, Artificial Sequence
  Synthetic oligonucleotide
uuguuuugcuuuugcgguaacugcacc

SEQ ID NO: 3015 - RNA, 27 nt, Artificial Sequence
  Synthetic oligonucleotide
uguuuugcuuuugcgguaacugcacca

SEQ ID NO: 3016 - RNA, 27 nt, Artificial Sequence
  Synthetic oligonucleotide
guuuugcuuuugcgguaacugcaccac

SEQ ID NO: 3017 - RNA, 27 nt, Artificial Sequence
  Synthetic oligonucleotide
uuuugcuuuugcgguaacugcaccacu

SEQ ID NO: 3018 - RNA, 27 nt, Artificial Sequence
  Synthetic oligonucleotide
ugcuuuugcgguaacugcaccacuaug

SEQ ID NO: 3019 - RNA, 27 nt, Artificial Sequence
  Synthetic oligonucleotide
aacccagcuguuuagcaaggaguguug

SEQ ID NO: 3020 - RNA, 27 nt, Artificial Sequence
  Synthetic oligonucleotide
cagcuguuuagcaaggaguguuggcuc

SEQ ID NO: 3021 - RNA, 27 nt, Artificial Sequence
  Synthetic oligonucleotide
uuuugugcuuacuacuguauagugcau

SEQ ID NO: 3022 - RNA, 27 nt, Artificial Sequence
  Synthetic oligonucleotide
uuugugcuuacuacuguauagugcaug

SEQ ID NO: 3023 - RNA, 27 nt, Artificial Sequence
  Synthetic oligonucleotide
uugugcuuacuacuguauagugcaugu

SEQ ID NO: 3024 - RNA, 27 nt, Artificial Sequence
  Synthetic oligonucleotide
gugcuuacuacuguauagugcaugugg

SEQ ID NO: 3025 - RNA, 21 nt, Artificial Sequence
  Synthetic oligonucleotide
agacucauaauccaacuguaa

SEQ ID NO: 3026 - RNA, 21 nt, Artificial Sequence
  Synthetic oligonucleotide
acaguuggauuaugagucuca

SEQ ID NO: 3027 - RNA, 21 nt, Artificial Sequence
  Synthetic oligonucleotide
ugagacucauaauccaacugu

SEQ ID NO: 3028 - RNA, 21 nt, Artificial Sequence
  Synthetic oligonucleotide
ugagacucauaauccaacuac

SEQ ID NO: 3029 - DNA, 40 bp, Artificial Sequence
  Synthetic oligonucleotide
gtcttcaagtagccaaaggcatgaaatatcttgcaagcaa

SEQ ID NO: 3030 - DNA, 25 bp, Artificial Sequence
  Synthetic oligonucleotide
cucagcauguuuguaaagcagaata

SEQ ID NO: 3031 - DNA, 25 bp, Artificial Sequence
  Synthetic oligonucleotide
cucagcauguuuguaaagcaggcta

SEQ ID NO: 3032 - DNA, 25 bp, Artificial Sequence
  Synthetic oligonucleotide
cucagcauguuuguaaagcaggaca

SEQ ID NO: 3033 - DNA, 25 bp, Artificial Sequence
  Synthetic oligonucleotide
cucagcauguuuguaaagcaggatc

SEQ ID NO: 3034 - RNA, 27 nt, Artificial Sequence
  Synthetic oligonucleotide
cauccugcuuuacaaacaugcugaguu

SEQ ID NO: 3035 - RNA, 27 nt, Artificial Sequence
  Synthetic oligonucleotide
ucuccugcuuuacaaacaugcugaguu

SEQ ID NO: 3036 - RNA, 27 nt, Artificial Sequence
  Synthetic oligonucleotide
uacccugcuuuacaaacaugcugaguu

SEQ ID NO: 3037 - RNA, 27 nt, Artificial Sequence
  Synthetic oligonucleotide
uauacugcuuuacaaacaugcugaguu

SEQ ID NO: 3038 - DNA, 25 bp, Artificial Sequence
  Synthetic oligonucleotide
cggaggaauaauaaauuugaucuaa

SEQ ID NO: 3039 - DNA, 25 bp, Artificial Sequence
  Synthetic oligonucleotide
cggaggaauaauaaauuugauucaa

SEQ ID NO: 3040 - DNA, 25 bp, Artificial Sequence
  Synthetic oligonucleotide
cggaggaauaauaaauuugauuuca

SEQ ID NO: 3041 - DNA, 25 bp, Artificial Sequence
  Synthetic oligonucleotide
cggaggaauaauaaauuugauuuac

SEQ ID NO: 3042 - RNA, 27 nt, Artificial Sequence
  Synthetic oligonucleotide
cuaaaucaaauuuauuauuccuccgaa

SEQ ID NO: 3043 - RNA, 27 nt, Artificial Sequence
  Synthetic oligonucleotide
ucaaaucaaauuuauuauuccuccgaa

SEQ ID NO: 3044 - RNA, 27 nt, Artificial Sequence
  Synthetic oligonucleotide
uucaaucaaauuuauuauuccuccgaa

SEQ ID NO: 3045 - RNA, 27 nt, Artificial Sequence
  Synthetic oligonucleotide
uuacaucaaauuuauuauuccuccgaa

SEQ ID NO: 3046 - DNA, 25 bp, Artificial Sequence
  Synthetic oligonucleotide
agacucauaauccaacuguaacaga

SEQ ID NO: 3047 - DNA, 25 bp, Artificial Sequence
  Synthetic oligonucleotide
agacucauaauccaacuguaaacga

SEQ ID NO: 3048 - DNA, 25 bp, Artificial Sequence
  Synthetic oligonucleotide
agacucauaauccaacuguaaaaaa

SEQ ID NO: 3049 - DNA, 25 bp, Artificial Sequence
  Synthetic oligonucleotide
agacucauaauccaacuguaaaagc

SEQ ID NO: 3050 - RNA, 27 nt, Artificial Sequence
  Synthetic oligonucleotide
ccuuuuacaguuggauuaugagucuca

SEQ ID NO: 3051 - RNA, 27 nt, Artificial Sequence
  Synthetic oligonucleotide
uauuuuacaguuggauuaugagucuca

SEQ ID NO: 3052 - RNA, 27 nt, Artificial Sequence
  Synthetic oligonucleotide
uccuuuacaguuggauuaugagucuca

SEQ ID NO: 3053 - RNA, 27 nt, Artificial Sequence
  Synthetic oligonucleotide
ucucuuacaguuggauuaugagucuca

SEQ ID NO: 3054 - DNA, 25 bp, Artificial Sequence
  Synthetic oligonucleotide
  misc_feature (22)..(25): n is a, c, g, t or u
cucagcauguuuguaaagcagnnnn

SEQ ID NO: 3055 - RNA, 27 nt, Artificial Sequence
  Synthetic oligonucleotide
  misc_feature (1)..(6): n is a, c, g, or u
nnnnnngcuuuacaaacaugcugaguu

SEQ ID NO: 3056 - DNA, 27 bp, Artificial Sequence
  Synthetic oligonucleotide
  misc_feature (22)..(27): n is a, c, g, or t
aactcagcatgtttgtaaagcnnnnnn

We claim:

1. An isolated double stranded nucleic acid (dsNA) comprising first and second nucleic acid strands comprising RNA, wherein said first strand is 15-35 nucleotides in length and said second strand of said dsNA is 19-35 nucleotides in length, wherein said second oligonucleotide strand is sufficiently complementary to SEQ ID NO: 1497 along at least 19 nucleotides of said second oligonucleotide strand length to reduce MET target mRNA expression when said double stranded nucleic acid is introduced into a mammalian cell.

2. An isolated dsNA molecule, consisting of: (a) a sense region and an antisense region, wherein said sense region and said antisense region together form a duplex region consisting of 25-35 base pairs and said antisense region comprises a sequence that is the complement of SEQ ID NO: 1497; and (b) from zero to two 3' overhang regions, wherein each overhang region is six or fewer nucleotides in length.

3. An isolated double stranded ribonucleic acid (dsNA) comprising first and second nucleic acid strands and a duplex region of at least 25 base pairs, wherein said first strand is 25-34 nucleotides in length and said second strand of said dsNA is 26-35 nucleotides in length and comprises 1-5 single-stranded nucleotides at its 3' terminus, wherein said second oligonucleotide strand is sufficiently complementary to SEQ ID NO: 1497 along at least 19 nucleotides of said second oligonucleotide strand length to reduce MET target gene expression when said double stranded nucleic acid is introduced into a mammalian cell.

4. An isolated double stranded ribonucleic acid (dsNA) comprising first and second nucleic acid strands and a duplex region of at least 25 base pairs, wherein said first strand is 25-34 nucleotides in length and said second strand of said dsNA is 26-35 nucleotides in length and comprises 1-5 single-stranded nucleotides at its 3' terminus, wherein the 3' terminus of said first oligonucleotide strand and the 5' terminus of said second oligonucleotide strand form a blunt end, and said second oligonucleotide strand is sufficiently complementary to SEQ ID NO: 1497 along at least 19 nucleotides of said second oligonucleotide strand length to reduce MET mRNA expression when said double stranded nucleic acid is introduced into a mammalian cell.

5. The isolated dsNA of claim 1 comprising a duplex region of at least 25 base pairs.

6. The isolated dsNA of claim 1, wherein said second oligonucleotide strand comprises 1-5 single-stranded nucleotides at its 3' terminus.

7. The isolated dsNA of claim 1, wherein said first strand is 25-35 nucleotides in length.

8. The isolated dsNA of claim 1, wherein said second strand is 25-35 nucleotides in length.

9. The isolated dsNA of claim 1, wherein starting from the first nucleotide (position 1) at the 3' terminus of the first oligonucleotide strand, position 1, 2 and/or 3 is substituted with a modified nucleotide.

10. The isolated dsNA of claim 1, wherein said 3' terminus of said first strand and said 5' terminus of said second strand form a blunt end.

11. The isolated dsNA of claim 1, wherein said first strand is 25 nucleotides in length and said second strand is 27 nucleotides in length.

12. The isolated dsNA of claim 1, wherein said second strand comprises a sequence selected from the group consisting of SEQ ID NO: 417.

13. The isolated dsNA of claim 1, wherein said first strand comprises a sequence selected from the group consisting of SEQ ID NO: 57.

14. The isolated dsNA of claim 1 comprising SEQ ID NO: 57 and SEQ ID NO: 417.

15. The isolated dsNA of claim 1, wherein each of said first and said second strands has a length which is at least 26 nucleotides.

16. The isolated dsNA of claim 9, wherein said modified nucleotide residue of said 3' terminus of said first strand is selected from the group consisting of a deoxyribonucleotide, an acyclonucleotide and a fluorescent molecule.

17. The isolated dsNA of claim 16, wherein position 1 of said 3' terminus of the first oligonucleotide strand is a deoxyribonucleotide.

18. The isolated dsNA of claim 6, wherein said nucleotides of said 1-5 single-stranded nucleotides of said 3' terminus of said second strand comprise a modified nucleotide.

19. The isolated dsNA of claim 18, wherein said modified nucleotide of said said 1-5 single-stranded nucleotides of said 3' terminus of said second strand is a 2'-O-methyl ribonucleotide.

20. The isolated dsNA of claim 18, wherein all nucleotides of said said 1-5 single-stranded nucleotides of said 3' terminus of said second strand are modified nucleotides.

21. The isolated dsNA of claim 1, wherein said dsNA comprises a modified nucleotide.

22. The isolated dsNA of claim 21, wherein said modified nucleotide residue is selected from the group consisting of 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino and 2'-O-(N-methylcarbamate).

23. The isolated dsNA of claim 6, wherein said 1-5 single-stranded nucleotides of said 3' terminus of said second strand are 1-3 nucleotides in length.

24. The isolated dsNA of claim 6, wherein said 1-5 single-stranded nucleotides of said 3' terminus of said second strand are 1-2 nucleotides in length.

25. The isolated dsNA of claim 6, wherein said 1-5 single-stranded nucleotides of said 3' terminus of said second strand is two nucleotides in length and comprises a 2'-O-methyl modified ribonucleotide.

26. The isolated dsNA of claim 1, wherein said second oligonucleotide strand comprises a modification pattern selected from the group consisting of AS-M1to AS-M46.

27. The isolated dsNA of claim 1, wherein said first oligonucleotide strand comprises a modification pattern selected from the group consisting of SM1to SM22.

28. The isolated dsNA of claim 1, wherein each of said first and said second strands has a length which is at least 26 and at most 30 nucleotides.

29. The isolated dsNA of claim 1, wherein said dsNA is cleaved endogenously in said cell by Dicer.

30. The isolated dsNA of claim 1, wherein the amount of said isolated double stranded nucleic acid sufficient to reduce expression of the target gene is selected from the group consisting of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of said cell.

31. The isolated dsNA of claim 1, wherein said isolated dsNA is sufficiently complementary to the target MET mRNA sequence to reduce MET target mRNA expression by an amount (expressed by %) selected from the group consisting of at least 10%, at least 50%, at least 80-90%, at least 95%, at least 98%, and at least 99% when said double stranded nucleic acid is introduced into a mammalian cell.

32. The isolated dsNA of claim 1, wherein the first and second strands are joined by a chemical linker.

33. The isolated double stranded nucleic acid of claim 1, wherein said 3' terminus of said first strand and said 5' terminus of said second strand are joined by a chemical linker.

34. The isolated double stranded nucleic acid of claim 1, wherein a nucleotide of said second or first strand is substituted with a modified nucleotide that directs the orientation of Dicer cleavage.

35. The isolated double stranded nucleic acid of claim 1 comprising a modified nucleotide selected from the group consisting of a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, and a locked nucleic acid.

36. The isolated double stranded nucleic acid of claim 1 comprising a phosphate backbone modification selected from the group consisting of a phosphonate, a phosphorothioate and a phosphotriester.

37. The isolated double stranded nucleic acid of claim 1 comprising a modification selected from the group consisting of a morpholino nucleic acid and a peptide nucleic acid (PNA).

38. A method for reducing expression of a target MET gene in a mammalian cell comprising contacting a mammalian cell in vitro with an isolated dsNA of claim 1 in an amount sufficient to reduce expression of a target MET mRNA in said cell.

39. The method of claim 38, wherein target MET mRNA expression is reduced by an amount (expressed by %) selected from the group consisting of at least 10%, at least 50% and at least 80-90%.

40. The method of claim 38, wherein MET mRNA levels are reduced by an amount (expressed by %) of at least 90% at least 8 days after said cell is contacted with said dsNA.

41. The method of claim 38, wherein MET mRNA levels are reduced by an amount (expressed by %) of at least 70% at least 10 days after said cell is contacted with said dsNA.

42. A method for reducing expression of a target MET mRNA in a mammal comprising administering an isolated dsNA of claim 1 to a mammal in an amount sufficient to reduce expression of a target MET mRNA in the mammal.

43. The method of claim 42, wherein said isolated dsNA is administered at a dosage selected from the group consisting of 1 microgram to 5 milligrams per kilogram of said mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, and 0.1 to 2.5 micrograms per kilogram.

44. The method of claim 42, wherein said administering step comprises a mode selected from the group consisting of intravenous injection, intramuscular injection, intraperitoneal injection, infusion, subcutaneous injection, transdermal, aerosol, rectal, vaginal, topical, oral and inhaled delivery.

45. A method for selectively inhibiting the growth of a cell comprising contacting a cell with an amount of an isolated dsNA of claim 1 sufficient to inhibit the growth of the cell.

46. The method of claim 45, wherein said cell is a tumor cell of a subject.

47. The method of claim 45, wherein said cell is a tumor cell in vitro.

48. The method of claim 45, wherein said cell is a human cell.

49. A formulation comprising the isolated dsNA of claim 1, wherein said dsNA is present in an amount effective to reduce target MET mRNA levels when said dsNA is introduced into a mammalian cell in vitro by an amount (expressed by %) selected from the group consisting of at least 10%, at least 50% and at least 80-90%.

50. The formulation of claim 49, wherein said effective amount is selected from the group consisting of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of said cell.

51. A formulation comprising the isolated dsNA of claim 2, wherein said dsNA is present in an amount effective to reduce target MET mRNA levels when said dsNA is introduced into a cell of a mammalian subject by an amount (expressed by %) selected from the group consisting of at least 10%, at least 50% and at least 80-90%.

52. The formulation of claim 51, wherein said effective amount is a dosage selected from the group consisting of 1 microgram to 5 milligrams per kilogram of said subject per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, and 0.1 to 2.5 micrograms per kilogram.

53. A mammalian cell containing the isolated dsNA of claim 1.

54. A pharmaceutical composition comprising the isolated dsNA of claim 1 and a pharmaceutically acceptable carrier.

55. A kit comprising the isolated dsNA of claim 1 and instructions for its use.

56. A composition possessing MET inhibitory activity consisting essentially of an isolated double stranded ribonucleic acid (dsNA) of claim 1.

* * * * *